United States Patent 12,760,100 (METHODS AND COMPOSITIONS TO IMPROVE THE SAFETY AND EFFICACY OF CELLULAR THERAPIES) - sequence listing, part 4

SEQ ID NO: 5775 - DNA, 1872 bp, Artificial Sequence
  Synthetic Polynucleotide
atggccttaccagtgaccgccttgctcctgccgctggccttgctgctccacgccgccaggccggacatcctgctgacacagagccccgccatcctgtccgtgtctccaggcgagagagtgtcctttagctgccgggccagccagaacatcggcaccagcatccactggtatcagcagcggaccaacggcagccccagactgctgattaagtacgccagcgagtccgtgtccggcatccccagcagattttctggcagcggctccggcaccgacttcaccctgagcatcaacagcgtggaaagcgaggacattgccgactactactgccagcacaccaatagctggcccaccacctttggcggaggcaccaagctggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactccagcagtccgacgccgagcttgtgaagcctggcgcttccgtgaagattagctgcaaggccagcggctacaccttcaccgaccacgccattcactgggtcaagcagaagcccgagcagggcctggaatggatcggctacttcagccccggcaacggcgacatcaagtacaacgagaagttcaagggcaaggccaccctgaccgccgacaagagcagcagcacagcctacatgcaactgaacagcctgaccagcgaggactccgccgtgtacttctgcaagcggagctacggcaactacgactactggggccagggcaccacactgaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5776 - DNA, 1887 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgcaagagcagccagagcctgctgaacagcggcgaccagaagaactacctgacctggtatcagcagaagcccggccagccccccaagctgctgatctactgggccagcaccagagaaagcggcgtgcccgatagattcagcggcagcggaagtggcaccgacttcaccctgaccatcagttctcttcaggccgaggacgtggccgtgtactactgccagaacgactacagctaccccctgaccttcggccagggcaccaaggtggaaatcaagctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggccgaagtgaagaaaaccggcagcagcgtgaaggtgtcctgcaaggccagcggctacacctttaccgaccacgccattcacgtgtggcggcaggctccaggacaggccctggaatggatgggccacttcagccccggcaacaccgacatcaagtacaacgacaagttcaagggcagagtgaccctgaccgtggaccgcagcatgagcaccgcctacatggaactgagcagcctgcggagcgaggacaccgccatgtactattgcaagaccagcaccttctttttcgactactggggccagggaacaatggtcaccgtgtccagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5777 - DNA, 1884 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagccaggacgtgtccattgccgtggcctggtatcagcagaagcccggcaaggcccccaaggtgctgatctacagcgccagctacagatacaccggcgtgcccgacagattcagcggctctggcagcggcaccgacttcaccttcaccatcagctccctccagcccgaggatattgccgtgtactactgccagcagcactacatcacccccctgacctttggcggaggcaccaaggtggaaatcaagctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacagatccaactggtgcagagcggccacgaagtgaagaaacctggggccagcgtgaaggtgtcctgcaaagccagcggctacacctttaccaactacggcatgaactgggtgcgccaggcccctggacagggcctggaatggatgggctggatcaacaccaagaccggcgagcccacctacgccgaagagttcaagggcagattcgtgttcagcctggaaaccagcgcctccaccgcctacctccagatcagctctctgaaggccgaggacaccgccatgtacttttgcggcagaggcggctacggcagcagctactggtacttcgatgtgtggggccagggcaccaccgtgaccgtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5778 - DNA, 1890 bp, Artificial Sequence
  Synthetic Polynucleotide
atggccttaccagtgaccgccttgctcctgccgctggccttgctgctccacgccgccaggccggacatcgtgatgacccagagccccgatagcctggccgtgtctctgggagagagagccaccatcaactgccgggccagcaagagcgtgtccaccagcggctacagctacatgcactggtatcagcagaagcccggccagccccccaagctgctgatctacctggcctccaacctggaaagcggcgtgcccgatagattcagcggcagcggctctggcaccgacttcaccctgaccatcagttctcttcaggccgaggacgtggccgtgtactactgccagcacagcagagagctgccctacaccttcggccagggcaccaagctggaaatcaagctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactccaggaatctggccctggccttgtgaagcccagcgagacactgagcctgacctgtaccgtgtccggcggcagcatcagctcttacggcgtgcactggattcggcagcctccaggcaagggcctggaatggatcggcgtgatctggacctccggcgtgaccgactacaacagcgccctgatgggcagagtgaccatctccgtggacaccagcaagaaccagttcagcctgaagctgagcagcgtgacagccgccgataccgccgtgtattattgcgccagagatggcgactacgaccgctacacaatggactactggggccagggaacccttgtgaccgtgtcctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5779 - DNA, 1827 bp, Artificial Sequence
  Synthetic Polynucleotide
atgacagccctgttcctgatgtccatgctgttcggcctggcctgcggacaggccatgtctttctgtatccccaccgagtacaccatgcacatcgagagaagagagtgcgcctactgcctgaccatcaacaccacaatctgcgccggctactgcatgacacgggatattaacggcaagctgttcctgcctaagtacgccctgagccaggacgtgtgcacctaccgggacttcatctaccggaccgtggaaatccctggctgccctctgcatgtggccccttactttagctaccccgtggctctgagctgcaagtgcggcaagtgcaacaccgactacagcgactgtatccacgaggccatcaagaccaactactgcaccaagcctcagaaaagctacctcgtgggcttctctgttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctcctgatgtgcaggattgccctgagtgcaccctgcaagagaaccccttcttctcccaacctggcgctcctatcctccagtgcatgggctgctgcttcagccgggcttatcccacacctctgcggagcaagaaaaccatgctggtccagaaaaacgtgaccagcgagagcacctgttgtgtggctaagagctacaacagagtgaccgtgatgggcggcttcaaggtggaaaatcacaccgcctgccactgctccacctgttactaccacaagagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5780 - DNA, 1878 bp, Artificial Sequence
  Synthetic Polynucleotide
atggccttaccagtgaccgccttgctcctgccgctggccttgctgctccacgccgccaggccgcagagcgtgctgacacagcctcctagcgtgtccgtgtctcctggccagaccgccagcatcacctgtagcggcgataagctgggcgataagtacgcctgctggtatcagcagaagcccggccagtctcccgtgctcgtgatctaccaggacagcaagaggcccagcggcatccccgagagattcagcggcagcaacagcggcaataccgccaccctgaccatcagcggcacccaggctatggacgaggccgactactactgccaggcttgggatagcagcaccgccgtggtgtttggcggaggcaccaagctgacagtgctgctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggccgaagtgaagaagcctggacagagcctgaagatcagctgcaaggccagcggctacagcctgaccgacaactggattggctgggtgcgccagaagccaggcaagggcctggaatggatgggcatcatctaccccggcgacagcgacaccagatacagccctagcttccagggccaagtgaccatctccgccgacaagagcatcaacaccgcctacctccagtggtccagcctgaaagcctccgacaccgccatctactactgtgtgggactggactggaactacaaccccctgcggtactggggacctggcacactcgtgaccgtgtcctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5781 - DNA, 1872 bp, Artificial Sequence
  Synthetic Polynucleotide
atggccttaccagtgaccgccttgctcctgccgctggccttgctgctccacgccgccaggccggacatcgtgatgacccagagccagaaattcatgagcaccagcgtgggcgaccgggtgtccatcatctgcaaggccagccagaacgtgggcaccttcgtggcctggtatcagcagaagcctggccagagccccaagctgctggtgtacagcgccagcaacagatacaccggcgtgcccgatagattcaccggcagcggctctggcaccgacttcaccctgaccatcaacaacatgcagagcgaggacctggccgactacttctgtcggcagtacagcagctacccctacaccttcggcggaggcaccaagctggaaatcaagctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactccagcagagcggccctgagcttgtgaagccaggggccagcatgaagattagctgcaaagccagcggctacagcttcagcgcctacaccatgaactgggtcaagcagagccacggcaagaacctggaatggatcggcctgattaacccctacaacggcggcaccaactacaaccaggaatttgagggcaaggccaccctgacagtgaacaagagcagcaacaccgccttcatggaactgctgagcctgaccagcgacgacagcgccgtgtactactgcgccagacgggactgggactacttcgactattggggccagggcaccacactgaccgtgtcctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5782 - DNA, 1905 bp, Artificial Sequence
  Synthetic Polynucleotide
atggccttaccagtgaccgccttgctcctgccgctggccttgctgctccacgccgccaggccggccatccagatgacccagagccctagcagcctgagcgccagcgtgggcgacagagtgaccatcacctgtagagccagccagagcatcagcaactacctgaactggtatcagcagaagcccggcaaggcccccaagctgctgatctatgccgccagctctctccagagcggcgtgcccagcagattttctggcagcggctccggcaccgacttcaccctgacaatcagcagcctccagcccgaggacttcgccacctactactgccagcagagctacagcagcccctccaccacctttggacagggcaccaagctggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggtggaatctggcggcggactgattcagcctggcggctctctgagactgagctgtgccgcctctggcttcaccgtgtcctccaactacatgagctgggtgcgccaggcccctggcaagggactggaatgggtgtccgtgacatacagcggcggcagcaccagctacgccgatagcgtgaagggccggttcaccatcagccgggacaacagcaagaacaccctgtacctccagatgaacagcctgcgggccgaggacaccgccgtgtactattgtgccaggggaggccggtactgctccagcatcagctgctatgccagaagcggctgcgactactggggccagggaacactcgtgaccgtgtccagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5783 - DNA, 1890 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacctgtagagccagccagagcatcggcaccagcctgcactggtatcagcagaagcctggcaaggcccccaagctgctgattaagttcgccagcagactgcagagcggcgtgcccagcagattttctggcagcggctccggcaccgacttcaccctgacaatcagctccctgcagcccgaggacttcgccacctactactgccagcagagccccggcttccctccaacctttggacagggcaccaagctggaaatcaagcggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactggtggaatctggcggcggacttgtgaagccaggcggcagcctgagactgagctgtgccgccagcggcttcagcatcaccaccagcggctactactggacctggatcagacagttccccggcaagggcctggaatggatgggctacatcggctacaacagcaagacctactacaaccccgccctgaagtcccggatcaccatcagcagagacaacgccaagaacagcctgtacctgcagatgaactccctgagagccgaggataccgccgtgtactactgcgccagatccctgtacggcggctacaaggacgccttcgatagctggggccagggaacccttgtgaccgtgtctagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5784 - DNA, 1893 bp, Artificial Sequence
  Synthetic Polynucleotide
atggccttaccagtgaccgccttgctcctgccgctggccttgctgctccacgccgccaggccggacgagatcgtgctgacacagagccctggcaccctgagcctgtctctgggagagagagccacactgagctgtcgggccagccagtctatcagcagcagcttcctggcctggtatcagcagaagcccggccaggcccctaagctgctgatctacgccgccagcacaagagccaccggcatccccgatagattcagcggctctggcagcggcaccgacttcaccctgaccatcagcagactggaacccgaggacttcgccgtgtactactgccagcagtacggcagaagcctgagcttcggcggaggcaccaaggtggaagtgaagctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactccagcagtctggccccggactcgtgaagcctagccagacactgagcctgacctgcgccatcagcggcgatagcgtgtccggcaatagcgccacctggaactggatcagacagagcccatctcggggcctggaatggctgggccggacctactaccgcagcaagtggaaccacgactacgccgagagcgtgaagtcccggatcaccatcaaccccgacaccagcaagaaccagttctccttgcaactgaacagcgtgacccccgaggacacagccgtgtattattgcgccagaggcgacagcagctcttggtacgccttcgactattggggccagggcaccctcgtgaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5785 - DNA, 1890 bp, Artificial Sequence
  Synthetic Polynucleotide
atggccttaccagtgaccgccttgctcctgccgctggccttgctgctccacgccgccaggccggaccagagcgtcgtgacacagcctcctagcgtgtcagtggcccctggcaagaccgccagaatcacctgtggccggaacaacatcggcagcaagagcgtgcactggtatcagcagaagcccggccaggctcctgtgctggtggtgtacgacgacagcgacagacccagcggcatccccgagagattcagcggcagcaactccggcaataccgccaccctgaccatcagcagagtggaagccggcgacgaggccgactactactgccaagtgtgggacagcagcagcgatcacgtggtgtttggcggaggcaccaagctgacagtgctgggtctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagtgcaactggtgcagtctggcggaggggtcatgcggcctggcggatctctgagactgtcttgtgccgccagcggcttcaccttcgacgactacggcatgagctgggtgcgccaggcccctggaaaaggcctggaatgggtgtccggcatcaactggaatggcggcagcaccggctacgccgattctgtgcggggcagattcaccatcagccgggacaacgccaagaacagcctgtacctgcagatgaactccctgcgggccgaggacaccgccctgtactattgcgccagagagcggggctacggctaccacgaccctcacgattattggggccagggcacccttgttaccgtgtcctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5786 - DNA, 1929 bp, Artificial Sequence
  Synthetic Polynucleotide
atggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5787 - DNA, 1911 bp, Artificial Sequence
  Synthetic Polynucleotide
atggccttaccagtgaccgccttgctcctgccgctggccttgctgctccacgccgccaggccggaacagaaactcatcagtgaagaagacctggaattcgacatccagatgacccagagccccagcacactgagcgccagcgtgggcgacagagtgaccatcacctgtcgggccagccagaacatcaacaagtggctggcctggtatcagcagaggcccggaaaagccccccagctgctgatctacaaggccagcagcctggaaagcggcgtgcccagcagattttctggcagcggctctggcaccgagtacaccctgaccatcagctccctccagcccgacgacttcgccacctactactgccagcagtacaacagctacgccaccttcggccagggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggccgaagtgaagaagcctggcgagagcctgaagatcagctgcaagggctccggctacaacttctctaacaagtggatcggctgggtgcgccagctgcctggcagaggactggaatggatcgccatcatctaccccggctacagcgacatcacctacagccccagcttccagggccgcgtgacaatcagcgccgacaccagcatcaacaccgcctacctgcactggcacagcctgaaggccagcgacaccgccatgtactactgcgtgcggcatacagccctggctggcttcgattattggggcctgggcaccctcgtgaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5788 - DNA, 1887 bp, Artificial Sequence
  Synthetic Polynucleotide
atggccttaccagtgaccgccttgctcctgccgctggccttgctgctccacgccgccaggccggacatcgtgctgacacagagccctgcttctctggccgtgtctctgggacagagagccaccatcagctgtagagccagcgagagcgtggacaactacggcaacaccttcatgcactggtatcagcagaagcccggccagcctcctaagctgctgatctacagagccagcaacctggaaagcggcatccccgccagattttctggcagcggcagcagaaccgacttcaccctgaccatcaatcccgtggaagccgacgacgtggcaacctactactgccagcagagcaacgaggaccctcctacatttggagccggcaccaagctggaactgaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacagattcagctggtgcagtctggccccgagctgaagaaacctggcgagacagtgaagatcagctgcaaggccagcggctacatcttcaccaattacggcatgaactgggtcaagcaggcccctggcaagagcttcaagtggatgggctggatcaacacctacaccggcgagagcacatacagcgccgacttcaagggcagattcgccttcagcctggaaaccagcgccagcacagcctacctgcacatcaacgacctgaagaacgaggacaccgccacctacttttgcgccagaagcggcggctacgaccctatggattattggggccagggcaccagcgtgaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5789 - DNA, 1884 bp, Artificial Sequence
  Synthetic Polynucleotide
atggccttaccagtgaccgccttgctcctgccgctggccttgctgctccacgccgccaggccggacgagatcgtgctgacacagagccctggcaccctgagcctgtctccaggcgaaagagccacactgagctgtcgggccagccagagcgtgtccaatacctacctggcctggtatcaccagaggcccggacaggctccccggctgctgatctatggcgcttctagcagagccaccggcatccccgatagattcagcggctctggcagcggcaccgacttcgccctgacaatcagctccctggaacccgaggacttcgccgtgtactactgccagcagtacagcaactcctggaccttcggccagggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactggtggaatctggcgggggagtggtgcagcctggcagaagcctgagactgtcttgtgccgccagcggcttcaccttcagcagctacgacatgcactgggtgcgccaggcccctggcaaaggactggaatgggtggccgtgatctcctacgacggcaccaacgagtattacgccgacagcgtgaagggccggttcaccatctccagagacaccagcaagaacaccctgtacctccagatgaacagcctgcgggccgaggacacagccgtgtattattgcgccagagagcggtacttcgactggtccttcgactactggggccagggaaccctggtgtccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5790 - DNA, 1887 bp, Artificial Sequence
  Synthetic Polynucleotide
atggccttaccagtgaccgccttgctcctgccgctggccttgctgctccacgccgccaggccggacgacatcgtgctgacacagacaccagccacactgagcgtgacacctggcgattctgtgtccctgagctgtagagccagccagagcatcagcaacaacctgcactggtatcagcagaagtcccacgagagccccagactgctgattaagaacgccagccagtctatcagcggcatccccagcaagtttagcggctctggcagcggcaccgacttcaccctgagaatcaacagcgtggaaaccgaggacttcgggatgtacttctgccagcagagcaatagctggccctacacatttggctccggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgaagctgcaacagagcggacccgagctggttaagccaggcgcttccgtgaagattagctgcaaggccagcggctacagcttcaccggctactacatgcactgggtcaagcagagccacggcaacatcctggactggatcggctacatctacccctacaacggcgtgtccagctacaaccagaagttcaagggcaaagccactctgaccgtggacaagagcagcagcaccgcctacatggaactgagaagcctgaccagcgaggacagcgccgtgtactattgtgccagagagcggggcctgtaccagctcagagcaatggattattggggccagggcaccagcgtgaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5791 - DNA, 1860 bp, Artificial Sequence
  Synthetic Polynucleotide
atggccttaccagtgaccgccttgctcctgccgctggccttgctgctccacgccgccaggccggacgacatcgtgatgacacagacccctgccatcatgagcgcctctccaggccagaaagtgaccatcacatgtagcgccagcagcagcgtgaactacatgcactggtatcagcagaagctgggcagcagccccaagctgtggatctacgataccagcaaactggcccctggcgtgccagccagattttctggttctggcagcggcaccagctacagcctgacaatcagcagcatggaagccgaggatgccgccagctacttctgccatcagtggtctagctacccctacacctttggctccggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctccaagagtctggccccgacctggtcaagcctagccaaagcctgagcctgacctgtaccgtgaccggctacagcatcacaagcggctatggatggcactggatcagacagttccccggcaacaaactggaatggatgggctacatccactacagcggcagcaccacctacaatcccagcctgaagtcccggatcagcatcagcagagacaccagcaagaaccagttcttcctgcaactgaacagcgtgaccaccgaggacaccgccacctactattgtgctcggagcctgagatattggggccagggcacaaccctgaccgtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5792 - DNA, 1869 bp, Artificial Sequence
  Synthetic Polynucleotide
atggccttaccagtgaccgccttgctcctgccgctggccttgctgctccacgccgccaggccggacgacatccagatgacacagagccctagcagcctgtctgccagcgtgggagacagagtgaccatcacctgtagcgccaccagcagcatcagctacatgcactggtatcagcagaagcccggcaaggcccctaaaggctggatctacgataccagcaaactggcccacggcgtgcccagcagattttctggttctggcagcggcaccgacttcaccctgacaatatctagcctccagcctgaggacttcgccacctactactgccaccagagaagaagctaccccttcaccttcggccagggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttcagagcggagccgaagtgaagaaacctggggcctctgtgaaggtgtcctgcaaggcttccggctacacctttaccaatttctggattcactgggtccgacaggctccaggccaaggactggaatggatcggagagatcgaccccagcgacagctacaccaactacaaccagaaattcaaaggccgggtcaccatcaccagagacaccagcacaagcaccgcctacctggaactgagcagcctgagaagcgaggacaccgccgtgtactactgcgccagggaaatcaccaccgtggattattggggccagggaaccctggtcaccgtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5793 - DNA, 1890 bp, Artificial Sequence
  Synthetic Polynucleotide
atggccttaccagtgaccgccttgctcctgccgctggccttgctgctccacgccgccaggccggacgacatccagatgacacagagccctagcagcctgtctgccagcgtgggagacagagtgaccatcacatgcaaggccagccagggcttcaacaaatacgtggcctggtatcagcagaagcccggcaaggctcctaagctgctgatctactacaccagcacactccagcctggcgtgcccagcagattttctggctctggcagcggcagagactacaccctgacaatatccagcctccagccagaggacttcgccacctactactgtctccagtacggcaacctgctgtacgcctttggacagggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagcttgtgcagagcggagccgaagtgaagaaacctggggcctctgtgaaggtgtcctgcaaagccagcggctacacctttaccagctactggatcggctgggtccgacaggctcctggacaaggactggaatggatcggcgacatctatcccggcggaggctacaccaactacaacgagaagttcaagggccgcgtgacaatcaccagagacacctctacaagcaccgcctacctggaactgagcagcctgagaagcgaggacaccgccgtgtactactgcgccagactggatggcagcagctacagaggcgctatggattcttggggccagggcacactggtcaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5794 - DNA, 1878 bp, Artificial Sequence
  Synthetic Polynucleotide
atggccttaccagtgaccgccttgctcctgccgctggccttgctgctccacgccgccaggccggacgacatccagatgacacagagccctagcagcctgtctgccagcgtgggagacagagtgaccatcacctgtagagccagccaggacatccggtactacctgaactggtatcagcagaagcccggcaaggcccctaagctgctgatctatgtggcctccagcctccagagcggagtgccttctagattttctggcagcggctccggcaccgagtttaccctgacagtgtctagcttgcagcccgaggacttcgccacctactactgcctgcaagtgtacagcacccctcggacctttggacagggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagcttgttgaatctggcggcggactggctaagcctggcggatctctgagactgtcttgtgccgccagcggcttccggttcaccttcaacaactactacatggactgggtccgacaggcccctggacaaggacttgaatgggtgtccagaatcagcagcagcggcgaccctacttggtacgccgattctgtgaagggcagattcaccatcagcagagagaacgccaagaacaccctgttcctccagatgaactccctgagagccgaggacaccgccgtgtactattgtgcctctctgaccaccggcagcgattcttggggacagggcgtgctggttaccgtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5795 - DNA, 1878 bp, Artificial Sequence
  Synthetic Polynucleotide
atggccttaccagtgaccgccttgctcctgccgctggccttgctgctccacgccgccaggccggagatcgtgatgacacagagccccgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatcggaagcctccagagcgaggacttcgccgtgtactactgccagcagtacaagacctggcctcggacctttggacagggcaccaacgtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcaacaatggggagccggcctgctgaagcctagcgaaacactgtctctgacctgcgccgtgttcggcggctctttcagcggctactactggtcctggatcagacagcctcctggcaaaggactggaatggatcggcgagatcaaccaccggggcaacaccaacgacaaccccagcctgaaaagcagagtgaccatcagcgtggacaccagcaagaaccagttcgccctgaagctgagcagcgtgacagccgctgataccgccgtgtattattgcgccagagagcggggctacacctacggcaatttcgatcactggggccagggcaccctggtcacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5796 - DNA, 1881 bp, Artificial Sequence
  Synthetic Polynucleotide
atggccttaccagtgaccgccttgctcctgccgctggccttgctgctccacgccgccaggccggagatcgtgatgacccctagcagcgccacactgagtgtgtctccaggcgaaagagccacactgtcctgtagagccagccagagcgtgtccagaaacctggcctggtatcagcagaagcctggacaggctccccggctgttgatctacggcgcttctacaagagccaccggcattcccgccagattttctggctctggcagcggcaccgagttcaccctgacaatctctagcctccagagcgaggacttcgccgtgtactactgccaccagtacagcaactggatgtgcagcttcggccagggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctccttgagtcaggtggcggcctggttcaacctggcggatctctgagactgagctgtgccgccagcggcttcacctttagcagatacgccatgaactgggtccgacaggcccctggcaaaggactggaatgggtgtccggcatctctggaagcggcggcagaacctactacgccgattctgtgaagggcagattcaccatcagccgggacaacagcaagaacaccctgtacctccagatgaacagcctgagagccgaggacacagccgtgtattattgcgccaaggaccgggacttttggagcggcccttttgactattggggccagggaaccctggtcaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5797 - DNA, 1896 bp, Artificial Sequence
  Synthetic Polynucleotide
atggccttaccagtgaccgccttgctcctgccgctggccttgctgctccacgccgccaggccggacatccagatgacccagagccccagcagcctgtctgccagcgtgggcgacagagtgaccatcacatgcaaggccagcaagaacatcagaagctacctggcctggtatcagcagaagcccggcaaggcccccaagctgctgatctacagcggcagcacactgcacagcggcgtgcccagcagattttccggctctggcagcggcaccgacttcaccctgaccatctctagcctccagcccgaggacttcgccacctactactgccagcagcaccacgagtaccccctgacattcggccagggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactccaggaatctggccccggactcgtgaagcccagcgagacactgagcctgacctgtaccgtgtccggctacaccatcaccagcggctacgactggtcctggatcagacagcctcctggcaagggcctggaatggatcggctacatcaactacggcggctccaccaactacaagcccagcctgggaagccgcgtgacaatcagcgtggacacctccaagaaccagttcagcctgaagctgagcagcgtgacagccgccgataccgccgtgtactactgcgcccggtacaacgagtacaagagctacatctacgattggtacttcgacttctggggccagggaaccctcgtgaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5798 - DNA, 1884 bp, Artificial Sequence
  Synthetic Polynucleotide
atggccttaccagtgaccgccttgctcctgccgctggccttgctgctccacgccgccaggccgcagtctgtgctgacacagcctgcctctgtgtctggctctcctggccagagcatcaccatcagctgtaccggcaccagctctgatgtcggcggctacaattacgtgtcctggtatcagcagcaccccggcaaggcccctaagctgatgatctacgacgtgaacaacagacccagcgaggtgtccaacagattcagcggcagcaagagcggcaataccgccagcctgacaatctctggactgcaagccgaggacgaggccgactactactgtagcagctacaccacaggcagcagagccgtttttggcggaggcaccaaactgacagtgcttggactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctggttcagtctggcgccgaagtgaagaagcctggcgagtctctgaccatctcctgcaaggccagcggctacagcttccccaactactggatcacctgggtccgacagatgtccggtggtggccttgagtggatgggcagaatcgatcccggcgactcctacaccacctacaatcctagcttccagggccacgtgaccatcagcatcgacaagagcaccaacaccgcctacctgcactggaacagcctgaaagccagcgacaccgccatgtactactgcgcccggtactatgtgtccctggtggacatttggggccagggcacactggtcacagtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5799 - DNA, 1902 bp, Artificial Sequence
  Synthetic Polynucleotide
atggccttaccagtgaccgccttgctcctgccgctggccttgctgctccacgccgccaggccgcagtctgtggtcacacagcctccatccgtgtctgctgcccctggacagaaagtgaccatctcctgtagcggcagcagcagcaacatcggcaacaactacgtgtcctggtatcagcagctccccggcacagctcccaaactgctgatctacgacaacaacaagcggcccagcggcatccccgatagattttctggcagcaagagcggcaccagcgccacactgggaattaccggacttcagacaggcgacgaggccgactactactgtggcacatgggatggcagcctgtacaccatgcttttcggcggaggcaccaagctgacagtgcttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggtggaatctggcggcggactggttaagcctggcggatctctgagactgtcttgtgccgccagcggcttcaccttcagcaatgcctggatgagctgggttcgacaggcccctggaaaaggactggaatgggtcggattcatccggtccaaagcctacggcggcaccacagaatatgccgcctctgtgaagggcagattcaccatcagccgggacgacagcaagtctatcgcctacctccagatgaacaacctgaaaaccgaggacaccgccgtgtactactgcgccagagatggcctgtacagcagctcttggtacgacagcgattactggggccagggcacactggtcacagtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5800 - DNA, 1917 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatctcttgtaccggcagcagcagcaatatcggagccggctatgacgtgcactggtatcagcagctccctggcacagcccctaaactgctgatcttcggcaacagcaacagacccagcggcgtgcccgatagattcagcggctttaagagcggcacaagcgccagcctggctatcactggactgcaagccgaggacgaggccgactacttctgccagagctacgatagcagcctgagcggcagcggagtgtttggcacaggcaccaaagtgacagtgcttggcctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaatgcaactggttcaaagcggcggtggcctggtgcaacctggaagaagtctgagactgagctgtgccgccagcggcttcaccttcgatgattacgccatgcactgggtccgacaggcccctggaaaaggactggaatgggtgtccggcatctcctggaatagcggctctatcggctacgccgacagcgtgaagggcagattcaccatcagccgggacaacgccaagaacagcctgtacctccagatgaactccctgagagccgaggatacagccctgtactactgcgccaaggacatccacagcggcagctactacggcctgctgtactacgctatggacgtgtggggccagggcacaaccgtgacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5801 - DNA, 1917 bp, Artificial Sequence
  Synthetic Polynucleotide
atggccttaccagtgaccgccttgctcctgccgctggccttgctgctccacgccgccaggccgctgcctgttctgacacagcctccatctgcctctggcacacctggacagagagtgaccatcagctgtagcggcagaagcagcaacatcggcagcaacagcgtgaactggtacagacagcttcctggcgctgcccctaagctgctgatctacagcaacaaccagcggcctcctggcgtgccagtcagattttctggcagcaagagcggcacaagcgccagcctggctatttctggactccagtctgaggacgaggccacctactactgtgccacctgggacgacaacctgaacgtgcactacgtgttcggcaccggcaccaaagtgacagtgcttggaagtagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacttgaaatggctcaggtgcagctggtgcagagcggagccgaagtgaagaaacctggcagcagcgtgaaggtgtcctgcaaagcttctggcggcaccttcagcagctacgccatctcttgggttcgacaggcccctggacaaggactggaatggatgggcagaatcatccccatcctgggaatcgccaactacgcccagaaattccagggcagagtgacaatcaccgccgacaagagcaccagcaccgcctacatggaactgagcagcctgagaagcgaggacaccgccgtgtactattgtgcaagaggcggctactacagccacgacatgtggagcgaagattggggccagggcacactggtcacagtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5802 - DNA, 1887 bp, Artificial Sequence
  Synthetic Polynucleotide
atggccttaccagtgaccgccttgctcctgccgctggccttgctgctccacgccgccaggccggatattgtgctgactcagagccctgccactctgagccttagtccaggcgacagagctaccatctcctgtagggcctctgaatccgtgaccattctgggctctcatctcatatattggtatcaacaaaagccgggccagcctccacggctgctcattcaactggcctctaacgtgcagaccggcgtgccagctagattttctggctctggctcccggaccgactttacactgacaatcagctccgtggaacccgaagattttgccgtctattattgcctccagtccaggaccattcctcggacattcggccagggaacaaaactcgaaatcaagcggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctcgttcagagtggccccgaagtgaaaaagccaggcgagtccgtgaagatttcctgcaaagcctccggctacacattccggcactactctatgaattgggtcaagcaggccccaggccagggccttaagtggatgggacgcatcaataccgagtccggcgtgccaatctacgccgatgacttcaaaggccggttcagcttcaccgtggatacctctgcctccaccgcctacctggaaatcagcagcctgaccagcgaggatacagctgtgtacttctgtagcaacgattacctctacagcctggatttctggggacagggaaccacactgaccgtgtctagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5803 - DNA, 1887 bp, Artificial Sequence
  Synthetic Polynucleotide
atggccttaccagtgaccgccttgctcctgccgctggccttgctgctccacgccgccaggccggacatcgtgctgacacagtctcccgccacactgtcactgagccctggcgatagagccacactgagctgtagagccagcgagagcgtgacaatcctgggcagccacctgatctactggtatcagcagaagcccggacaggcccctagactgctgattcagctcgccagcaatgtgcagacaggcatccctgccagattttccggcagcggcagcagaaccgatttcaccctgaccataagcagcctggaacctgaggacttcgccgtgtactactgcctccagagccggacaatccccagaacctttggacagggcaccaagctggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctggtgcagtctggcagcgagctgaagaaacctggcgagagcgtgaagatcagctgcaaggccagcggctacaccttcacacactacagcatgaactgggtccgacaggcccctggacaaggactggaatggatgggcagaatcaacaccgagacaggcgagcccctgtacgccgacgatttcaagggcagattcgtgttcagcctggacaccagcgccagcacagcctatctccagatcagctctctgaaggccgaggacaccgccgtgtactactgctccaacgactacctgtactccctggactattggggccagggcacactggtcacagtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5804 - DNA, 1899 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5805 - DNA, 1899 bp, Artificial Sequence
  Synthetic Polynucleotide
atggccttaccagtgaccgccttgctcctgccgctggccttgctgctccacgccgccaggccggacttcgtgatgacacagagccctgatagcctggccgtgtctctcggcgagcgagtgaccatgagctgcaagtctagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctacccctacaccttcggccagggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcaactggttcagagcggagccgagctgaagaaacctggggccagcgtgaaggtgtcctgtaaagccagcggctacacctttaccgactactacatgaaatgggtccgacaggccccaggccagggactcgaatggatcggcgatattatccccagcaacggggccaccttctacaaccagaaattcaagggccgcgtgaccatcaccgtggacaagagcacaagcaccgcctacatggaactgagcagcctgagaagcgaggacaccgccgtgtattattgcgccagaagccatctgctgcgggccagttggttcgcctattggggacagggaaccctggtcaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5806 - DNA, 1881 bp, Artificial Sequence
  Synthetic Polynucleotide
atggccttaccagtgaccgccttgctcctgccgctggccttgctgctccacgccgccaggccggagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcaggactacggcttcccttggacctttggacagggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcaactggttcagagcggagccgaagtgaagaagcctggcgagagcctgaagattagctgcaaaggctccggctactccttcaccagctactggatctcttgggtccgacagatgcccggcaaaggactggaatggatgggcatcatcgaccccagcgacagcgacaccagatacagccctagcttccagggccaagtgaccatcagcgccgacaagagcatcagcacagcctacctccagtggtcctctctgaaggccagcgataccgccatgtactattgcgccagaggcgacggcagcaccgacctggattattggggacagggaaccctggtcaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5807 - DNA, 1887 bp, Artificial Sequence
  Synthetic Polynucleotide
atggccttaccagtgaccgccttgctcctgccgctggccttgctgctccacgccgccaggccgcagttcgtgctgacacagcctccaagcgtgtccaccaatcctggcagcacagtgaagctgagctgcaagagaaacaccggcaacatcggcagcaactacgtgaactggtatcagcagaagcccggacagagccccaccaccatgatctacagagatgacaagaggcccgacggcgtgcccgatagattttccggctctatcgacagaagcagcaacagcgccctgctgaccatcaacaacgtgcagacagaggacgaggccgactacttctgccagagctacagcagcggcatcaacatcatcttcggcggaggcaccaagctgacagttcttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcagctccaagaatctggccctggcctggtcaagcctagcgagacactgagcctgacctgtaccgtgtccggctttagcctgaccacctacgacgtgcactgggtccgacaacctccaggcaaaggactggaatggatgggcagaatccagaacgccggcatcaccgactacaatagcgccctgaagtcccggctgattatctccagagacaccagcaagagccaggtgttcctgaagatgaacagcgtgaccaccgccgacaccgccatgtacttttgtgccaagaccggcagctacttctacgccttcgatcactggggccagggcacactggttaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5808 - DNA, 1878 bp, Artificial Sequence
  Synthetic Polynucleotide
atggccttaccagtgaccgccttgctcctgccgctggccttgctgctccacgccgccaggccggacatccagatgacacagtctccagccagcctgtctgcctctctgggagagacagtgaccatcgagtgcagacccagcgaggacatccacagcaacgtggcctggtatcagcagaagcccggcaattctccccagctgctgatctacgacgccagcaatctggctgatggcgtgcccagcagattttctggcagcggctctggcacacagtacagcctgaagatcaacagcctccagagcgaggacgtggcctcctacttctgccaccagtacaacatctacccctacaccttcggcagcggcaccaagctggaacttaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcaagagtctggccccacactggtcaagcctggcgatagcgtgaagatgagctgcaaggccagcggctacacctttaccgactacatcatccactgggtcaagcagagccacggcaagagcctggaatggatcggctacatcaacccttacagcgacggcaccaactacaacgagaagttcaagagcaaggccacactgaccgtggacaagagcaccagcacagcctacatggaattttcccggctgacctccgaggacagcgccatctatttctgcgccctgaactacggcagctactacgctatggatgcctggggccagggcacaagcgtgacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5809 - DNA, 1881 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacctttggacagggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctccttgagagtggtggcggcctggttcaacctggcggatctctgagactgtcttgtgccgccagcggcttcacctttagcggctattggatgcactgggtccgacaggcccctggcaaaggacttgaatgggtgtccgccatcagaagcgacggcagcagcaagtactacgccgactctgtgaagggcagattcaccatcagccgggacaacagcaagaacaccctgtacctccagatgaacagcctgagagccgaggacacagccgtgtattattgcgccaaggacggcgtgatcgaggacacctttgattactggggccagggcaccctggtcaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5810 - DNA, 1869 bp, Artificial Sequence
  Synthetic Polynucleotide
atggccttaccagtgaccgccttgctcctgccgctggccttgctgctccacgccgccaggccggacgtgcagatcacacagagccctagctacctggctgcctctcctggcgagacaatcaccatcaactgtcgggccagcaagagcatcagcaaggacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcacaacaagtacccctacacctttggcggaggcaccaagctggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcaactgcaacagcctggggccgagcttgttagacctggcgcttctgtgaagctgagctgcaaggccagcggctacaccttcaccagctactggatgaactgggtcaagcagcggcctgaccagggcctcgaatggatcggcagaatcgacccctacgacagcgagacacactacaaccagaagttcaaggacaaggccatcctgaccgtggacaagagcagctccaccgcctacatgcaactgagcagcctgacctctgaggatagcgccgtgtactattgcgccagaggcaactgggacgactattggggccagggcacaaccctgacagtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5811 - DNA, 1878 bp, Artificial Sequence
  Synthetic Polynucleotide
atggccttaccagtgaccgccttgctcctgccgctggccttgctgctccacgccgccaggccggacatccagatgacacagtctccagccagcctgtctgcctctctgggagagacagtgaccatcgagtgccggaccagcaaggacatctacagcaacctggcctggttccagcaagagcccggcaattctcctcagctcctgatctacgacgccagcaatctggctgatggcgtgcccagcagattttctggcagcggctctggcacacagtacagcctccagatcaacaacctccagagcgaggacgtggcctcctacttctgccaccagtacaacaactacccctacaccttcggcaccggcaccaagctggaacttaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcagctccaagagtctggccccacactggtcaatcctggcgacagcgtgaagatgagctgcaaggccagcggctacacctttaccgaccacatcatccactgggtcaagcagagccacggcaagagcctggaatggatcggctacatcaacccctatagcggcggagccaactacaacggcaagttcaagagcaaggccacactgacaatcgacaagagcagcagcaccgcctacatggaattttccagactgaccagcggcgactccgccatctactactgcgccctgaattacggcagctactacgctatggatgcctggggccagggcacaagcgtgacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5812 - DNA, 1875 bp, Artificial Sequence
  Synthetic Polynucleotide
atggccttaccagtgaccgccttgctcctgccgctggccttgctgctccacgccgccaggccggagatcgtgctgacacagagccctaccagcatgacagcctctccaggcgagcaagtgaccatcacctgtagagccagcagcagcatcaactacatgcactggtatcagcagaagcctggcgcaagccccagaccttggatctacgagacaagcaagctggcctccggcgtgcccgatagattttctggatctgccagcggcaccagctacagcctgaccatcaacaacatggaagccgaggacgccgccacctactactgccagcagtggaattacccctcctggacctttggcggaggcaccaagctggaacttaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctcgttgagtctggtggcggactggttcagcctggaagaagcctgaagctgagctgtgccgccagcggcttcaccttcagcgactacaatatggcctgggtccgacaggcccctaagaaaggactggaatgggtcgccaccatcctgtacgatggcggcagaacctactaccggggcagcgtgaagggcagattcaccatcagcagagacaacgccaagagcaccctgtacctgcggatggactctctgagaagcgaggataccgccacatattactgtgccacacacagccggggcaccgactactttgattattggggccagggcgtgatggttaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5813 - DNA, 1902 bp, Artificial Sequence
  Synthetic Polynucleotide
atggccttaccagtgaccgccttgctcctgccgctggccttgctgctccacgccgccaggccggacatcgtgatgacacagagcccttctagcctggccgtgtctgagggcgagacagtgaccatcaactgcaagagcagccagagcttcctgtctagcggcgacggcaagaattacgtggcctggtatcagtacaagcccggacagagccccaagctgctgatctactgggccagcacaagacagagcggcgtgcccgatagattcatcggctctggcagcggcaccgacttcaccctgacaatctctacagtgcaggccgaggacctggctatctactactgccagcagtattacgacacccctctgacctttggctccggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgaagctgcaagagtctggccccagcctggtgcagagtagccaaacactgagcctgacctgtaccgtgtccggctttagcctgaccagctaccacatccactgggtccgacagacccctggcaaaggactggaatggatgggcgtgatgtggagcgacggcgacaccagctataacagcgccctgaagtcccggctgagcatcagcagagatacaagccagagccaggtgttcctgaagatgaacagcctccagaccgaggacaccgccacctactattgtgccagaggctactacagcagctacctgtacctttggttcgcctattggggccagggcaccctggttacagtcagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5814 - DNA, 1914 bp, Artificial Sequence
  Synthetic Polynucleotide
atggccttaccagtgaccgccttgctcctgccgctggccttgctgctccacgccgccaggccggacgtgctgatgacccagacacctgtgtctctgccagtgtctctcggaggccaggtgtccatctcctgtagaagcagccagagcctggtgcactccgacggcgatacctacctgcactggtatctccagaagcctggacagagccctcagctcctgatctaccgggtgtccaacagattcagcggcgtgcccgatagattttccggcagcggctctggcaccgacttcaccctgaagatcagcagagtggaacccgaggacctgggcctgtactactgtctccagaccacacacttcccaccttggacctttggcggaggcaccaagctggaaatgaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctccagcagtctggacccgagcttagaaggccaggatctagcgtcagactgagctgcaaggccagcggctaccggatcaaggacttcctgatccactggattaagaacagacccgagcacggcctggaatggatcggatggattgaccctgaggacggcgagactaagtacgcccagaagttccagaccaaggccacactgaccgccgacacctctagcaacaccgcctacatgcaactgagcagcctgaccagcgaggacaccgccacctacttttgtgctagatggggcgacgtgtactacggcctgatgagaggccatgtgatggatgcctggggccagggaacaagcgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5815 - DNA, 1899 bp, Artificial Sequence
  Synthetic Polynucleotide
atggccttaccagtgaccgccttgctcctgccgctggccttgctgctccacgccgccaggccggacatcgtgatgacacagagccccgccacactgtcactgtctccaggcgaaagagccacactgagctgtcggagcagcaagagcctccagaacgtgaacggcaacacctacctgtactggttccagcagaagcccggccagtctcctcagctcctgatctacagaatgagcaacctgaacagcggcgtgcccgacagattttctggcagcggaagcggcaccgagttcaccctgaccataagcagcctggaacctgaggacttcgccgtgtactactgtatgcagcacctggaataccccatcaccttcggagccggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttgaatctggcggcggactggttaagcctggcggatctctgaagctgagctgtgccgccagcggctacacctttaccagctacgtgatgcactgggtccgacaggcccctggcaaaggacttgagtggatcggctacatcaacccctacaacgatggcaccaagtacaacgagaagttccagggcagagtgaccatcagctccgacaagagcatcagcaccgcctacatggaactgagcagcctgagaagcgaggataccgccatgtactattgcgccagaggcacctactactacggcaccagagtgttcgactactggggccagggaaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5816 - DNA, 1887 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5817 - DNA, 1887 bp, Artificial Sequence
  Synthetic Polynucleotide
atggccttaccagtgaccgccttgctcctgccgctggccttgctgctccacgccgccaggccggacatcgtgctgacacagagccctgccatcatcacagcctctccaggcgagaaagtgaccatgacctgtagagccagcagcagcgtgaactacatggactggtatcagaagaagcccggcagcagccccaagccttggatctacgccacaagcaatctggcctctggcgtgcccagcagattttctggctctggcagcggcaccacctacagcatgacaatctctagcctggaagccgaggacgccgccacctactattgtcagcagtggtccttcaatcctcctaccttcggcggaggcaccaagctggaaatcaaaagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagcttcagcagagcggagccgagctgaagaaacctggcgcttctgtgaaggtgtcctgcaaggccagcggctacacctttaccagctacaacatgcactgggtcaagcagaccccaggccagggactcgaatggatcggagccatctatcccggcaacggcgacacctcctacaaccagaagttcaagggcaagaccacactgaccgccgacaagagcagctccaccgcctacatggaactgagcagcctgagatccgaggataccgccgtgtactactgcgccagaagcaactactacggcagctcctactggttcttcgacgtgtggggcaccggcacaaccgtgacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5818 - DNA, 1896 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcgactggcccctgacatttggcggcggaacaaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttcaatcaggtggcggcctggttcaccctggcggatctctgagactgtcttgtaccggcagcggcttcaccttcagctaccacgccatgcactgggtccgacaggcacctggaaaaggactggaatgggtgtccatcatcggcacaggcggcgtgacctactacgccgattctgtgaagggcagattcaccatcagccgggacaacgtgaagaacagcctgtacctccagatgaactccctgagagccgaggatatggccgtgtattattgcgccagagactactacggcgctggcagcttttacgacggcctgtacggaatggatgtgtggggccagggaaccaccgtgactgtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5819 - DNA, 1890 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccctgacatttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagctgtgcagctcgttgagtctggcggaggacttgttcagcctggcagatccctgagactgtcttgtgccgccagcggcttcaccttcggcgattacacaatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactattgcaccaaggacaaccagtacggctccggcagcacatacggacttggagtttggggccagggcaccctggttacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5820 - DNA, 1887 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagcctctgatctacgcccctagcaatctggcctctggcgtgccaagcagattttctggcagcggctctggcaccgacttcaccctgacaatatccagcctccagcctgaggacttcgccacctactactgccagcagtggtccttcaatcctcctaccttcggccagggcaccaaggtggaaatcaaaagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagcttgttgaatctggcggcggactggttcagcctggcggatctctgagactgtcttgtgccgccagcggctacaccttcaccagctacaatatgcactgggtccgacaggcccctggcaaaggacttgaatgggtcggagccatctatcccggcaacggcgacacctcctacaaccagaagttcaagggcagattcaccatcagcgtggacaagagcaagaacaccctgtacctccagatgaactccctgagagccgaggacaccgccgtgtactattgtgccagagtggtgtactacagcaacagctactggtacttcgacgtgtggggccagggaaccctggtcacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5821 - DNA, 1893 bp, Artificial Sequence
  Synthetic Polynucleotide
atggccttaccagtgaccgccttgctcctgccgctggccttgctgctccacgccgccaggccgcagatcgtgctgtctcagtctcctgccatcctgagcgcttccccaggcgagaaagtgaccatgacctgtagagccagcagcagcgtgtcctacatgcactggtatcagcagaagcccggcagcagccctaagccttggatctacgccaccagcaatctggcctctggcgtgccagccagattttctggctctggcagcggcaccagctacagcttcacaatcagcagagtggaagccgaggacgccgccacctactattgtcagcagtggaccttcaatcctcctaccttcggcggaggcacccggctggaaatcaaaagaacagtggctgctctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggcttatctgcaacagagcggagccgaactcgtcagacctggcgcttctgtgaagatgagctgcaaggccagcggctacaccttcaccagctataatatgcactgggtcaagcagacccctcggcagggactcgaatggatcggcggaatctatcccggcaacggcgacacctcctacaaccagaagttcaagggcaaagccacactgaccgtgggcaagagcagcagcaccgcctatatgcagctcagcagcctgaccagcgaggacagcgccgtgtacttctgcgccagatacgactacaactacgctatggactactggggccagggcaccagcgtgacagttagctctgccagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5822 - DNA, 1884 bp, Artificial Sequence
  Synthetic Polynucleotide
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcagcagcctgagcttcatgcactggtatcagcagaagcccggcaaggcccctaagccttggatctacgccaccagcaatctggcctctggcgtgccaagcagattttctggcagcggctctggcaccgactacaccctgacaatatccagcctccagcctgaggacttcgccacctacttttgccaccagtggtccagcaatcctctgacctttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactggtgcagtctggggccgaagtgaagaaacctggggcctctgtgaaggtgtcctgcaaggcttccggctacacctttaccagctacaatatgcactgggtccgacaggctcccggccagagacttgaatggatcggagccatctatcccggcaacggcgacacctcctacaaccagaaattcaagggccgcgtgaccgtgaccagagacacatctgccaacaccgcctacatggaactgtctagcctgaagtccgaggacaccgccgtgtactactgtgccagaagccactacggcagcaactacgtggactacttcgactactggggccagggcacactggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5823 - DNA, 1887 bp, Artificial Sequence
  Synthetic Polynucleotide
atggccttaccagtgaccgccttgctcctgccgctggccttgctgctccacgccgccaggccggagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagcggagcaactggcccatcacattcggccagggcacccggctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggtgcagcttgttgagtctggcggaggactggtgcagcccgatagaagcctgagactgtcttgtgccgccagcggcttcaccttccacgattatgccatgcactgggtccgacaggcccctggcaaaggacttgaatgggtgtccaccatctcttggaacagcggcacaatcggctacgccgactctgtgaagggcagattcaccatcagccgggacaacgccaagaacagcctgtacctccagatgaactccctgagagccgaggacacagccctgtactactgcgccaaggacatccagtacggcaactactactacggcatggacgtgtggggccagggcacaacagtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5824 - DNA, 1890 bp, Artificial Sequence
  Synthetic Polynucleotide
atggccttaccagtgaccgccttgctcctgccgctggccttgctgctccacgccgccaggccggacatccagctgacacagagcccttctagcctgtctgccagcgtgggcgacagagtgaccatcacatgtagagccagccagggcatcagctctgtgctggcttggtatcagcagaagcctggcaaggcccctaagctgctgatctacgatgccagcagcctggaaagcggcgtgccaagcagattttctggcagcggctctggcaccgacttcaccctgacaatatccagcctccagcctgaggacttcgccacctactactgccagcagttcaacagcagcatcaccttcggccagggcaccaagctggaaatcaagagaacagtggcagccctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagtctggggccgaagtgaagaaacctggcagcagcgtgaaggtgtcctgcaaagcaagcggcggcaccttcagcgattacgccatctcttgggtccgacaggcccctggacaaggactggaatggatgggcagaatcatccccatcctgggcgtcgccaattacgcccagaaattccagggccgcgtgacaatcaccgccgacaagtctaccagaaccgcctacatggaactgagcagcctgagaagcgaggacaccgccgtgtactactgcgccagaaattgggccgacgccttcgacatttggggccagggaacaatggtcaccgtgtctagcgcctccacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5825 - DNA, 1887 bp, Artificial Sequence
  Synthetic Polynucleotide
atggccttaccagtgaccgccttgctcctgccgctggccttgctgctccacgccgccaggccggacatcgtgatgacacagagccctagcagcctgtctgcctctctcggcggcaaagtgaccatcacatgcaaggccagccaggacatcaacaagtatatcgcctggtatcagcacaagcccggcaagggacctagactgctgatccactacaccagcacactccagcctggcatccccagcagattttctggcagcggctccggcagagactacagcttcagcatcagcaacctggaacctgaggacattgccacctactactgcctccagtacgacaacctgctgacctttggagccggcaccaagctggaactgaaaagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgaaactccagcagagcggccctgagctggttaagcctggcaccagcgtgaaggtgtcctgtaaagccagcggctactccttcaccgactacaacatgtactgggtcaagcagagccacggcaagagcctggaatggatcggctacatcgacccctacaaaggcggcaccatctacaaccagaagttcaagggcaaagccacactgaccgtggacaagagcagcagcaccgccttcatgcacctgaacagcctgaccagcgaggacagcgccgtgtactattgcgccagagagatgattaccgcctactacttcgactactggggccagggaagcagcgtgaccgttagctctctggaaagaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5826 - DNA, 1872 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagatagagtgaccatcaactgcaaggccagccaggacatcaacagctacctgagctggttccagcagaagcctggcaaggcccctaagacactgatctaccgggccaacagactggtggatggcgtgccaagcagattttctggcagcggcagcggccaggattacaccctgacaatatccagcctccagcctgaggacttcgccacctactactgcctccagtacgacgagttccctctgacctttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcaactggtgcagtctggggccgaagtgaagaaacctggggcctctgtgaaggtgtcctgcaaagccagcggctacacctttaccaactacgacatcaactgggtccgacaggctccaggccaaggactggaatggatcggctggatctatcctggcgacggcagcaccaagtacaacgagaagttcaaggccaaggccacactgaccgccgataccagcacaagcaccgcctacatggaactgcggagcctgagaagcgacgacaccgccgtgtactattgtgcctccggctacgaggacgctatggactattggggccagggcaccaccgtgacagtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5827 - DNA, 1887 bp, Artificial Sequence
  Synthetic Polynucleotide
atggccttaccagtgaccgccttgctcctgccgctggccttgctgctccacgccgccaggccggagatcgtgctgacacagagccctctgagcctgcctgttacacctggcgagcctgccagcatctcctgtagaagctctcagagcctgctgcacagcaacggctacaactacctggactggtatctccagaagcctggacagagcccacagctcctgatctacctgggcgtgaactctgtgtccggcgtgcccgatagattttctggcagcggctctggcaccgacttcaccctgaagatcagcagagtggaagccgaggacgtgggcgtgtactactgtatgcaggccctccagacaccttggacattcggccagggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcaactggttcagagcggagccgaagtgaagaaacctggcagcagcgtgaaggtgtcctgcaaagcctctggcggcatcttcagcaaccacgccatctcttgggtccgacaggctcctggacaaggactggaatggatgggcggcatcatccccatcttcggcacagccaattacgcccagaaattccagggcagagtgaccatcaccgccgacgagtctaccagcaccgccttcatggaactgagcagcctgagaagcgaggacaccgccgtgtactattgcgccagagaatgggccgacgtgttcgacatttggggccagggaacaatggtcaccgtgtcctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5828 - DNA, 1884 bp, Artificial Sequence
  Synthetic Polynucleotide
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5829 - DNA, 1884 bp, Artificial Sequence
  Synthetic Polynucleotide
atggccttaccagtgaccgccttgctcctgccgctggccttgctgctccacgccgccaggccggacatccagatgacacagtctccagccagcctgaccgtgtcactgggacagagagccaccatctcttgcagagccagcgagagcgtggacagctacggcaatagctacctgcactggtatcagcagaagcccggccagcctcctcagctcctgatctacctggcctccaatctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggttcagctccagcagagcggagccgagcttgtgaaacctggcgcttccgtgaagatgagctgcaaagccttcggctacaccttcaccacctttccaatcgagtggatgaagcagagccacggcaagagcctggaatggatcggcaactttcacccctacaacgaccagaccaagtacaacgaagagttcaagggcagagccaagctgaccatcgacagatccagcagcaccgtgtacctggaactgggcagactgacctccgatgacagcgccgtgtactactgtgccagaggctactactacgccttcgacttttggggccagggcaccacactgacagtgtctagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5830 - DNA, 1875 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatcagaaacgacctcggctggtatcagcagaagcctggcaaggcccctaagcggctgatctatgccgcttcctctctgcaatctggcgtgcccagcagattttctggcagcggctctggcaccgagttcaccctgacaatatccagcctccagcctgaggacttcgccacctactactgcctccagcacaacagctacccctggacctttggacagggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttgaatctggcggcgctctgattcagcctggcggatctctgagactgagctgtgtggcctccggctttaccatcagcggcaactacatgagctgggtccgacaggcccctggcaaaggacttgaatgggtgtccctgatctacagcggcgacagcacctattacgccgacagcgtgaagggcagattcaccatcagccgggacatcagcaagaacaccgtgtacctccagatgaactccctgagagtggaagataccgccgtgtactactgcgtccgcgacggctactacgtgtccgatatggttgtgtggggcaagggcaccaccgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5831 - DNA, 1878 bp, Artificial Sequence
  Synthetic Polynucleotide
atggccttaccagtgaccgccttgctcctgccgctggccttgctgctccacgccgccaggccggacatcgtgatgacccagacacctctgagcctgagcgtgacacctggacagcctgccagcattagctgcaagagcagccagtctctgctggacggcgacggcaagacctacctgaattggctgctccagaagcctggacagagccctcagcggctgatctacctggtgtccaagctggatagcggcgtgcccgatagattttctggcagcggctctggcaccgacttcaccctgaagatcagcagagtggaagccgaggacgtgggcgtgtactactgttggcagggcacacacttccccagaacattcggccagggcacaaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcaactggttcagagcggagccgaagtgaagaaacctggggcctctgtgaaggtgtcctgcaaggccagcggctacaccttcaaggacacctacatccactgggtccgacaggcccctggacaaggacttgagtggatgggcagaatcgaccccgccaacggcaacaccaaatacgaccccaagttccagggcagagtgaccatgaccagagacaccagcatcagcaccgcctacatggaactgagccggctgagatccgatgacaccgccgtgtactattgcgctagaagaggcggagtggattggggccagggaacactggttaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5832 - DNA, 1881 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggttccagcagaagcctggaaaagcccctaagctgctgatctacagccccagctacagatacaccggcgtgcccagcagattttctggcagcggctctggcaccgacttcaccctgacaatatccagcctccagcctgaggacttcacctactactgccagcagctctacagcaccccttacacattcggccagggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttcagagcggagccgaagtgaagaaacctggggcctctgtgaaggtgtcctgcaaagccagcggctacacctttaccgactactacctggacgtggtcgtgcggcaagctcctggacaaggactggaatggatcggcagagtgaacccctacaacggcggcaccatctacaaccagaaattcaagggaagagtgaccctgaccagagacaccagcacctccacagcctacctggaactgagcagcctgagaagcgaagataccgccgtgtactactgcgccagggaccactacagatatgaccctctgctggactactggggccagggaaccctggttacagtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5833 - DNA, 1899 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagagcgtgtccaccagcagctacaactacatgcactggtatcagcagaagcccggcaagcctcctaagctgctgattaagtacgccagcaacctggaaagcggcgtgcccagcagattttctggcagcggctctggcaccgacttcaccctgacaatatccagcctccagcctgaggacttcgccacctactactgtcagcactcctgggagatccctctgacattcggccagggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttcagagcggagccgaagtgaagaaacctggggcctctgtgaaggtgtcctgcaaggccagcggctacagcttcaccgactattatatgcactgggtccgacaggctccaggccagggacttgagtggatcggcagaatcaacccctacaacggcgctgccttctacagccagaacttcaaggatagagtgaccctgaccgtggacaccagcaccagcacagcctacctggaactgagcagcctgagaagcgaggacaccgccgtgtactactgcgccattgagagaggcgctgacctggaaggctacgctatggattattggggccagggaaccctggtcaccgtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5834 - DNA, 1893 bp, Artificial Sequence
  Synthetic Polynucleotide
atggccttaccagtgaccgccttgctcctgccgctggccttgctgctccacgccgccaggccggagatcgtgctgacacagtctccagccacactgagcgcttctccaggcgagagagtgaccctgacctgtagagccagcagcaacgtgatctccagctacgtgcactggtatcagcagaagcctggcagcagccccagactgtttctgtacagcaccagcaatctggcctccggcgtgccaagcagattttctggctctggcagcggcaccgacttcacctttaccatctctagcctggaagccgaggacgccgccacctactactgtcagcagtacagcggctaccctctgaccttcggccagggcacaagactggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcaagagtctggccctggcctggtcaagcctagcgaaacactgagcctgacctgcgccgtgtctggctactctatcaccagcgcctactattggaactggatcagacagcctcctggcaaaggactggaatggatcggctacatcagctacgacggcagaaacaactacaaccccagcctgaagaaccggatcaccatcaatcccgacaccagcaagaaccagttcagcctccagctgaacagcgtgacccctgaggataccgccgtgtactactgtgccagagaaggcgactacgacgtgggcaactactacgctatggactactggggccagggaaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5835 - DNA, 1893 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagcagcaacgtgatctccagctacgtgcactggtatcagcagaagcctggacaggcccctcggctgctgatctacagcacaagcaatctggcctctggcatccccgccagattttctggctctggaagcggcaccgacttcaccctgaccataagcagcctggaacctgaggacttcgccgtgtactactgccagcagtatagcggctaccctctgaccttcggccagggcacaagactggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggtggaaagtggcggcggactggtgcaacctggaagaagcctgagactgtcctgtgccgccagcggctactctatcacaagcgcctactactggaactgggtccgacaggctcctggcaaaggactggaatgggtgtcctacatcagctacgacggcagaaacaactacaaccccagcctgaagaaccgcttcaccatcagccgggacaacgccaagaagtccctgtacctccagatgaacagcctgagagccgaggacacagccctgtactattgcgccaaagagggcgactacgacgtcggcaactactacgctatggactactggggccagggaaccaccgtgactgtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5836 - DNA, 1887 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagccaggatgtgtctacagccgtggcctggtatcagcagaagcctggaaaggcccctaagctgctgatctacagcgccagctacagatacaccggcgtgcccgatagattcacaggctctggcagcggcaccgacttcaccctgacaatatctagcctccagcctgaggacttcgccacctactactgccagcagcactacagcacccctccatacacatttggcggaggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcaactggttcagagcggagccgaagtgaagaaacctggggcctctgtgaaggtgtcctgcaaagccagcggctacgcctttagcagctcctggatgaactgggtccgacaggctcctggacagggcctcgaatggatcggcagaatctatcctggcgacggcgacaccaagtacaacggcaagttcaagggcaaagccacactgaccgccgacaagagcacaagcaccgcctacatggaactgagcagcctgagaagcgaggacaccgccgtgtactactgtgccagatccaccatgatcgccaccggcgctatggattattggggccagggaaccctggtcaccgtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5837 - DNA, 1890 bp, Artificial Sequence
  Synthetic Polynucleotide
atggccttaccagtgaccgccttgctcctgccgctggccttgctgctccacgccgccaggccggacgtggtcatgacacagacacctctgagcctgagcgtgacacctggacagcctgccagcatcagctgtagaagcagccagagcctggtgcacaacaacggcaacacctacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacacacgtgccaccttacacctttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgagtctggtggcggactggttcaacctggcggaagcctgagactgtcttgtgccgccagcggcttcaccttcagcgactactatatggcctgggtccgacaggcccctggcaaaggacttgaatgggtcgccgagatcaactacgacggcagcagcacctactacgtggacagcgtgaagggcagattcaccatcagccgggacaacgccaagaacagcctgtacctccagatgaactccctgagagccgaggataccgccgtgtactactgcgccagagacagaggcttctacttcgactattggggccagggcaccaccgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5838 - DNA, 1890 bp, Artificial Sequence
  Synthetic Polynucleotide
atggccttaccagtgaccgccttgctcctgccgctggccttgctgctccacgccgccaggccggacgtggtcatgacacagacacctctgagcctgagcgtgacacctggacagcctgccagcatctcctgtagaagcagccagagcctggtgcacagcaacggcctgacatacctgcactggtatctccagaagcctggacagagccctcagctcctgatctacaaggtgtccaacagattcagcggcgtgcccgacagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccagcatcaactacgacggcgagagcacctactacgtggacagcgtgaagggcagattcaccatcagccgggacaacgccaagaacagcctgtacctccagatgaactccctgagagccgaggataccgccgtgtactactgcgccagagacagaggctactacttcgactattggggccagggcaccaccgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5839 - DNA, 1890 bp, Artificial Sequence
  Synthetic Polynucleotide
atggccttaccagtgaccgccttgctcctgccgctggccttgctgctccacgccgccaggccggacgtggtcatgacacagagccctctgagcctgcctgtgacacctggcgaacctgccagcatctcctgtagaagcagccagagcctggtgcacagcaacggcaatacctacctgcactggtatctccagaagcctggacagagcccacagctcctgatctacaaggtgtccaaccggttcagcggcgtgcccgatagattttctggcagcggctctggcaccgacttcaccctgaagatcagcagagtggaagccgaggacgtgggcgtgtacttctgtagccagagcacacacgtgccacctttcacctttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctcgttgagtctggtggcggactggttcaacctggcggaagcctgagactgtcttgtgccgccagcggcttcaccttcagcgactactatatggcctgggtccgacaggcccctggcaaaggacttgaatgggtcgccgacatcaactacgatggcggcagcacctactacctggacagcctgaagtcccggttcaccatctccagagacaacgccaagaacagcctgtacctccagatgaactccctgagagccgaggataccgccgtgtactactgcgccagagacagaggctactacttcgactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5840 - DNA, 1884 bp, Artificial Sequence
  Synthetic Polynucleotide
atggccttaccagtgaccgccttgctcctgccgctggccttgctgctccacgccgccaggccggacatccagatgacccagagcagcagctacctgagcgtgtcccttggcggcagagtgaccatcacctgtaaagccagcgaccacatcaacaactggctggcctggtatcagcagaagcctggcaacgcccctagactgctgattagcggagccacctctctggaaacaggcgtgccaagcagattttccggcagcggctctggcaaggactacaccctgagcatcaccagcctccagaccgaggatgtggctacctactactgccagcagtattggagcaccccttggacctttggcggaggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctccagcagtctggcgctgagcttgctagacctggcgcttctgtgaagctgagctgcaaggccagcggctacaccttcaccagctactggatgcagtgggtcaagcagaggccaggccaaggactggaatggatcggagccatctatcccggcgacggcgataccagatacacccagaagttcaagggcaaagccacactgaccgccgacaagagcagctccacagcctacatgcaactgagcagcctggcttccgaggacagcgccgtgtactattgtgccagaggcaaggtgtactacggcagcaaccctttcgcctattggggccagggaaccctggttacagtgtctgctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5841 - DNA, 1884 bp, Artificial Sequence
  Synthetic Polynucleotide
atggccttaccagtgaccgccttgctcctgccgctggccttgctgctccacgccgccaggccggacatcgtgatgacccagagccacaagttcatgagcaccagcgtgggcgacagagtgtccatcacctgtaaagccagccaggacgtgtcaacagccgtggcctggtatcagcagaagcctggacagagccccaagctgctgatctacagcgccagctacagatacaccggcgtgcccgatagattcacaggctctggcagcggcaccgacttcacctttacaatcagcagcgtgcaggccgaggacctggccgtgtattattgccagcagcactacagcacccctccatacacatttggcggaggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctccagcagtctggccctgagcttgtgaaacctggcgcttccgtgaagattagctgcaaggccagcggctacgccttcagcagctcctggatgaactgggtcaagcagaggccaggccagggcctcgaatggatcggcagaatctatcctggcgacggcgacaccaagtacaacggcaagttcaagggcaaagccacactgaccgccgacaagtctagcagcaccgcctatatgcagctcagcagcctgacctctgtggacagcgccgtgtacttctgtgcccggtctaccatgattgccaccggcgctatggattactggggccagggaacaagcgtgaccgtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5842 - DNA, 1890 bp, Artificial Sequence
  Synthetic Polynucleotide
atggccttaccagtgaccgccttgctcctgccgctggccttgctgctccacgccgccaggccggacgtggtcatgacacagaccccactgagcctgcctgtgtctctgggagatcaggccagcatctcctgtagaagcagccagagcctggtgcacagcaacggcaacacctacctgcggtggtatctccagaagcctggacagagccccaaggtgctgatctacaaggtgtccaacagagtgtccggcgtgcccgatagattttctggcagcggctctggcaccgacttcaccctgaagatcaatagagtggaagccgaggacctgggcgtgtacttctgtagccagagcacccatgtgccttggacctttggcggaggcaccaagctggaaatcaagctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaaggcgtgaagctggacgagacaggcggaggacttgttcaacctggcggagccatgaagctgagctgtgtgaccagcggctttaccttcggccactactggatgaactgggtccgacagtcccctgagaaaggactggaatgggtcgcccagttcagaaacaagccctacaactacgaaacctactacagcgacagcgtgaagggcagattcaccatcagccgggacgacagcaagtccagcgtgtacctccagatgaacaacctgcgcgtggaagataccggcatctactactgtaccggggccagctacggcatggaatatctcggccagggcaccagcgtgaccgtgtctacaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5843 - DNA, 1908 bp, Artificial Sequence
  Synthetic Polynucleotide
atggccttaccagtgaccgccttgctcctgccgctggccttgctgctccacgccgccaggccgcaggtgcaactggtggaatctggcggcaatctggttcagcctggcggctctctgagactgtcttgtgccgccagcggcttcaccttcggcagcttttctatgagctgggtccgacaagctcctggcggaggacttgaatgggtggcaggactgtctgccagaagcagcctgacacactacgccgactctgtgaagggcagattcaccatcagccgggacaacgccaagaacagcgtgtacctccagatgaacagcctgagagtggaagataccgccgtgtactactgcgccagaagaagctacgacagcagcggctactggggccacttctacagctacatggatgtgtggggccagggcaccctggttacagtttctctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaatctgtgctgacccagcctagctccgtgtctgctgctcctggacagaaagtgaccatctcctgtagcggcagcaccagcaacatcggcaacaactacgtgtcctggtatcagcagcaccccggcaaggcccctaagctgatgatctacgacgtgtccaagaggcccagcggcgtgccagatagattttccggcagcaagagcggcaacagcgccagcctggatattagcggactccagtctgaggacgaggccgactactattgcgccgcctgggatgatagcctgagcgagtttctgtttggcaccggcaccaagctgacagtgcttggaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5844 - DNA, 1881 bp, Artificial Sequence
  Synthetic Polynucleotide
atggccttaccagtgaccgccttgctcctgccgctggccttgctgctccacgccgccaggccgcagtctgtggtcacacagcctccatctgtgtctggcgctccaggccagagagtgaccatctcttgtaccggcagcagcagcaatatcggagccggctatgacgtgcactggtatcagcagctccctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggcagctatgtgtttggcaccggcaccaagctgacagtgcttggactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcaactggtggaaaccggcggcaacctggttcaacctggcgcttctctgagactgagctgtgccgccagcggctttagctttagcggaacagccatgcactgggtccgacaggcacctggcaaaggactggaatgggtgtccaccatcagcagcacaggcagaagcacctactaccgggacagcgtgaagggcagattcaccatctccagagacaacagcaagaacaccctgtacctccagatgaacagcctgagaggcgaggacaccgccgtgtactattgtgccagagtgtccttcgactactggggccagggaaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5845 - DNA, 1887 bp, Artificial Sequence
  Synthetic Polynucleotide
atggccttaccagtgaccgccttgctcctgccgctggccttgctgctccacgccgccaggccgcagtctgtggttacacagcctgcctccgtgtctggctctcctggccagagcatcaccatcagctgtaccggcaccagctctgatgtcggcggctacaattacgtgtcctggtatcagcagcaccccggcaaggcccctaagctgatgatctacgacgtgtccaagaggcccagcggcgtgtccaatagattcagcggcagcaagagcggcaacaccgccagcctgacaatttctggactgcaagccgaggacgaggccgactactactgtagcagctacaccagcagcagcacactggtgtttggcggaggcaccaagctgacagttcttggactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctggttgaaagcggcggagcctttgttcagcctggcggatctctgagactgagctgtgccgccagcggcttcacattttccagctacgccatgacctgggtccgacaggctcctggcaaaggactggaatgggtgtccaccatctccggcagaggcagaagcaccttctacgccgatagcgtgaagggcagattcacaatcagccgggacaacagcaagaacaccctgtacctccagatgaacagcctgagagccgaggataccgccgtgtactactgtgcccggtactatcacgctggcgcctttgatctttggggccagggaacactggtcaccgtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5846 - DNA, 1893 bp, Artificial Sequence
  Synthetic Polynucleotide
atggccttaccagtgaccgccttgctcctgccgctggccttgctgctccacgccgccaggccggacgtggtcatgacacagagcccttctagcctgtctgccagcgtgggcgacagagtgacaatcacctgtcagagcagcctggacatcagccactacctgaactggtatcagcagaagcccggcaaggcccctaagctgctgatctacgacgccagcaatctggaaaccggcgtgcccagcagattttctggcagcggaagcggcacccacttcaccttcacaatatccagcctccagcctgaggacttcgccacctactactgccagcagtacgacaacctgcctctgacctttggcggaggcaccaagctggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcaactggttcaatcaggcggaggcgtggtgcaacctggtggctctctgagagtgtcttgtgctgcctctggcgtgaccctgagcgactatggaatgcactgggtccgacaggcccctggcaaaggacttgagtgggtcgccttcatcagaaacgacggcagcgacaagtattacgccgacagcgtgaagggcagattcaccatcagccgggacaacagcgagaaaaccgtgtctctccagatgtctagcctgagagccgaggacaccgccgtgtactactgtgccaagaatggcgagagcggccctctggactactggtatctggatctgtggggcagaggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5847 - DNA, 1905 bp, Artificial Sequence
  Synthetic Polynucleotide
atggccttaccagtgaccgccttgctcctgccgctggccttgctgctccacgccgccaggccgagctacgagctgacacagcctccatccgtgtctggcacacctggacagagagtggctatctcctgtagcggcagcagcagcaacatcggcaccagaatggtcacctggtatcagcacgtgccaggcacagcccctaagctgctgatcttcaacaacaaccagcggcctagcggcgtgcccgatagattttctgccagcaagagcggcacaagcgccagcctggctatcatcggactccagtctgacgacgaggccgactactactgtgccacctgggacgacaacgtgaagtcctacgtgttcggcaccggcaccaaagtgacagtgcttggaagtagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacttgaaatggcccaggttcagctccagcagtggggagctggactgctgaagcctagcgagacactgagcctgacctgtgctgtgtacggcggcagcttcagcggctactactggtcctggatcagacagcctcctggcaaaggactggaatggatcggcgagatcaaccacagcggctccaccaactacaaccccagcctgaagtccagagtgaccatcagcgtggacaccagcaagaaccagttctccctgaagctgagcagcgtgacagccgctgataccgccgtgtactattgcgctagagcccctcagtcttggtacgtgggagatgtgtggggccagggcacactggttacagtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5848 - DNA, 1896 bp, Artificial Sequence
  Synthetic Polynucleotide
atggccttaccagtgaccgccttgctcctgccgctggccttgctgctccacgccgccaggccgcagtctgtgctgacacagcctcctagcctgtctgtggcccctggaaagacagccagcatcacatgcggcggcaacaacatcggcatgaagtccgtgcactggtatcagcagaggccaggacaggctcctgtgctggtcatctactacgacagcgacagaccctctggcatccccggcagattttccggcagcaactctggcaataccgccacactgaccatctccagagtggaagctggcgacgaggccgactactactgccaagtgtgggataccaccggcgatcaccctggctatgtgtttggcaccggcaccaaagtgacagtgcttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcaactggttcagagcggagccgaagtgaagaaacctggcagcagcgtgaaggtgtcctgcaaagcaagcggcggcacctttagcagctacgccatctcttgggtccgacaggcacctggacaaggactggaatggatgggcggcatcatccccatcttcggcacagccaattacgcccagaaattccagggcagagtgaccatcaccgccgacgagtctacaagcaccgcctacatggaactgagcagcctgagaagcgaggacaccgccgtgtactattgtgccagaggcgtgtacggctacagcggctctgccccttatgatgagtggggccagggaaccctggtcaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5849 - DNA, 1875 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcaactggttcagagcggtgccgaagtgcggaagcctggcagctctgtgaaggtgtcctgtaaagcctccggcggcagcttcaacaactaccccatcttctgggtccgacaggcccctggacagggctttgaatggatgggcagaatcatccccatcctgggcatcaccgcctacgctcagaaattccagggccgcgtgacaatcaccgccgacaagtctacaagcacagcctacatggaactgaacagcctgcggagcgaggacaccgccgtgtattattgtgccggcggagatgacctggacgcctttgacatttggggccagggaacaatggtgtccgtgtcctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5850 - DNA, 1887 bp, Artificial Sequence
  Synthetic Polynucleotide
atggccttaccagtgaccgccttgctcctgccgctggccttgctgctccacgccgccaggccgcaggttcagctccagcagtctgatgccgagctggtcaagcctggcagcagcgtgaagattagctgcaaggccagcggctacaccttcaccgatcacgccatccactgggtcaagcagaagcctgagcagggcctcgaatggatcggccactttagccctggcaacaccgacatcaagtacaacgacaagttcaagggcaaagccacactgaccgtggacagaagcagcagcacagcctacatgcagctgaacagcctgaccagcgaggacagcgccgtgtacttctgcaagaccagcaccttctttttcgactactggggccagggcacaaccctgacagtttcttctctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaactggttatgacacagagccccagcagcctgacagtgacagccggcgagaaagtgaccatgatctgcaagtctagccagagcctgctgaactccggcgatcagaagaactacctgacctggtatcagcagaaacccggccagcctcctaagctgctgatcttctgggccagcaccagagaaagcggcgtgcccgatagattcacaggcagcggcagcggaaccgacttcaccctgacaatcagctctgtgcaggccgaggacctggccgtgtattactgccagaacgactacagctaccctctgacctttggagccggcaccaagctggaactgaagacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5851 - DNA, 1890 bp, Artificial Sequence
  Synthetic Polynucleotide
atggccttaccagtgaccgccttgctcctgccgctggccttgctgctccacgccgccaggccggaggtgcaactggttgagtctggcggaggactggtgcagcctggaagaagcctgagactgtcttgtgccgccagcggcttcaccttcgacgattatgccatgcactgggtccgacaggcccctggcaaaggacttgaatgggtgtccggcatctcctggaacagcggctctatcggctacgccgattccgtgaagggcagattcaccatcagccgggacaacgccaagaacagcctgtacctccagatgaactccctgagagccgaggacacagccctgtactactgcgccaaagacaaaggcggaggctactacgacttttggagcggcagcgattattggggccagggcacactggtcacagtgtctagcctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaatcttctgagctgacacaggaccctgccgtgtctgttgctctgggccagacagtgcggattacctgtcagggcgatagcctgagaagctactacgcctcctggtatcagcagaagccaggccaggctcctgtgctggtcatctacggcaagaacaacagacccagcggcatccccgatagattcagcggaagcagctctggcaataccgccagcctgacaattactggcgctcaggccgaggacgaggccgactactactgcaacagcagagatagcagcggctgggttttcggcggaggcacaaaactgacagtgctgacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5852 - DNA, 1917 bp, Artificial Sequence
  Synthetic Polynucleotide
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgctgagcaacagcgacacctggaactggatcagacagagccctagcagaggactggaatggctgggcagaacctaccacagaagcacttggtacgacgactacgccagctctgtgcggggcagagtgtccatcaatgtggacaccagcaagaaccagtacagcctgcaactgaacgccgtgacacctgaggataccggcgtgtactactgcgccagagacagactccaggacggcaactcttggagcgacgcctttgatgtgtggggccagggcacaatggtcaccgtttctagcctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactggtgtacgtgttcggcacaggcaccaaagtgaccgtgcttacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5853 - DNA, 1851 bp, Artificial Sequence
  Synthetic Polynucleotide
atggccttaccagtgaccgccttgctcctgccgctggccttgctgctccacgccgccaggccgcaggtgcaactggttcagtctggggccgaagtgaagaaacctggggcctctgtgaaggtgtcctgcaaggcttccggctacacctttaccagctacgacatcaactgggtccgacaggccacaggccaaggactggaatggatgggctggatgaaccccaacagcggcaataccggctacgcccagaaattccagggcagagtgaccatgaccagaaacaccagcatcagcaccgcctacatggaactgagcagcctgagaagcgaggacaccgccgtgtactattgcgccagaggcgacagcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaatctgtgctgacccagcctagatccgtgtctggctctcctggacagagcgtgaccatctcttgtaccggcaccagctctgatgtcggcggctacaattacgtgtcctggtatcagcagcaccccggcgaagcccctaagctgattatctacgacgccgacaagcggcccagcggcatcagcaatagattcagctctggcaagagcggcaacaccgccagcctgacaatcagcggactccaggtggaagatgaggccgactactactgctgctcctatgccggcggaagcacctgggttttcggaggcggtacaaaagtgaccgtgctgacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5854 - DNA, 1917 bp, Artificial Sequence
  Synthetic Polynucleotide
atggccttaccagtgaccgccttgctcctgccgctggccttgctgctccacgccgccaggccggaagtgcagctccagcagtctggacctggcctggttaagcctagccagacactgagcctgacctgtgccatcagcggcgatagcgtgtcctctaatagcgccgcctggaactggatcagacagagccctagcagaggactggaatggctgggcagaacctactaccgcagcaagtggtacagcgactacgccgtgtccgtgaagtcccggatcaccatcaatcccgacaccagcaagaaccagttcagcctgcaactgaacagcgtgacccctgaggataccgccgtgtactactgcgccagagatccctacgacttttggagcggctaccccgacgcctttgacatctggggacagggcacaatggtcaccgtttctagcctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaatctgctctgacacagcctgccagcgtgtcaggatctcctggacagagcatcaccatctcttgcaccggcaccagctctgatgtcggcggctacaattacgtgtcctggtatcagcagcaccccggcaaggcccctaaagtgattatcagcgaagtgaacaacagacccagcggcgtgtcccacagattcagcggctctaagtctggcaacaccgccagcctgacaatctctggactgcaagccgaggacgaggccgactacttctgtagcagctacaccagcggcagaaccctgtacgtgttcggcacaggcagcaaagtgacagtgctgggaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5855 - DNA, 1914 bp, Artificial Sequence
  Synthetic Polynucleotide
atggccttaccagtgaccgccttgctcctgccgctggccttgctgctccacgccgccaggccgcaatctgctctgacacagcctgccagcgcctctggatctcctggacagagcgtgaccatctcctgtaccggcacctcttctgatgtcggcggctacaactacgtgtcctggtatcagcagcaccccggcaaggcccctaagctgatgatctacgacgtgtccaacagacccagcggcgtgtccaatagattctccggcagcaagagcggcaacaccgccagcctgacaatttctggactgcaagccgaggacgaggccgactactactgtagcagctacaccagcagcagcacactgtacgtgttcggcacaggcacccagctcacagttcttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctccagcagtctggacctggcctggttaagcctagccagacactgagcctgacctgtgccatcagcggcgattccatgctgagcaacagcgacacctggaactggatcagacagagccccagcagaggcctggaatggctgggcagaacataccacagaagcacttggtacgacgactacgccagctctgtgcggggcagagtgtccatcaatgtggacaccagcaagaaccagtacagcctgcaactgaacgccgtgacacctgaggataccggcgtgtactactgtgccagagtgcggctccaggacggcaattcttggagcgacgcctttgatgtgtggggccagggcacaatggtcaccgtttctagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5856 - DNA, 1914 bp, Artificial Sequence
  Synthetic Polynucleotide
atggccttaccagtgaccgccttgctcctgccgctggccttgctgctccacgccgccaggccggacgtgatgctgacccagacaccactgagcctgcctgtgtctctgggcgatcaggccagcatctcctgtagaagcagccagagcatcctgcacagcaccggcgatacctacctggaatggtatctccagaagcctggacagagccccaagctgctgattaacaaggtgtccaaccggctgagcggcgtgcccgatagattttctggcagcggctctggcaccgacttcaccctgaagatcagcagagtggaagccgaggacctgggcgtgtactactgcttccaaggcagccatgttccttggacctttggcggaggcaccaagctggaaatcaagagagctgacgccgctcctaccgtgtccatctttcctctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgaagctccagcagagcggccctagccttgtgaaacctggcgcttccgtgaagatgagctgcaaggccagcggctacaccttcaccgatttctacatgaaatgggtcaagcagagccacggcaagtctctggaatggatcggcgacatcaaccccaacatcggagacaccttctacaaccagaagttcaagggcaaagccacactgaccgtggacaagagcagcagcaccgcctacatgcagctcaacagcctgaccagcgaggacagcgccgtgtacttttgttccgtgggctacttcgacgtgtggggagccggaacaaccgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5857 - DNA, 1902 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagagccagccagagcgtgtccatctacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcctcctttcacattcggccctggcaccaaggtggacatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagcttgttgaaagcggaggcggagttgtgcagcctggcagaagtctgagactgtcttgtgccgccagcggcttcaccttcagcagctatggaatgcactgggtccgacaggcccctggcaaaggacttgaatgggttgccgtgatctgggacgacggcagcaacaagtattacgtggacagcgtgaagggcagattcaccatcagccgggacaacagcaagaacaccctgtacctccagatgaacagcctgagagccgaggacacagccgtgtattattgcgccagagatgactactacggcagcggctccttcaacagctactatggcacagacgtgtggggccagggcacaacagttaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5858 - DNA, 1857 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccagggcatctcttcttggctggcctggtatcagcagaagcccgagaaggcccctaagagcctgatctatgccgccagctctctccagagcggagtgcctagcagattttctggcagcggctccggcaccgatttcaccctgacaatatccagcctccagcctgaggacttcgccacctactactgccagcagtacaacagctacccctacaccttcggccagggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcaactggttcaatctggcggcggactggttcatccaggcggttctctgagactgagctgtgccggctctggcttcaccttcagcacctacctgatgtactgggtccgacaggcccctggcaagacactggaatgggtgtccgctattggcagcggaggcgatacctactacgccgactctgtgaagggcagattcaccatcagccgggacaacgccaagaacagcctgtacctccagatgaactccctgagagccgaggacatggccgtgtactactgtgccagaggactcggctattggggccagggaacactggtcacagtgtcctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5859 - DNA, 1914 bp, Artificial Sequence
  Synthetic Polynucleotide
atggccttaccagtgaccgccttgctcctgccgctggccttgctgctccacgccgccaggccgctgcctgttctgacacagcctccatccgtgtctgtggcccctggaaagaccgccagaatcacatgcggcggcaacaacatcggcagcaagagcgtgcactggtatcagcagaagcctggacaggctcctgtgctggtggtgtacgacgacagcgatagacctagcggcatccccgagagattcagcggcagcaattccggcaataccgccacactgaccatcagcagagtggaagctggcgacgaggccgactactactgccaagtgtgggacagcagcagcgactacgtggtgtttggcggcggaacaaagctgacagtgcttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcaactggtgcagagcggagccgaagtgaagaagccaggcgagagcctgaagattagctgcaaaggcagcggctacagcttcaccagctactggatcggctgggtccgacagatgcctggcaaaggactggaatggatgggcatcatctaccccggcgacagcgacaccagatacagccctagctttcagggccaagtgaccatctccgccgacaagagcatcagcacagcctacctccagtggtcctctctgaaggccagcgataccgccatgtactactgcgccagacaagtctggggatggcaaggcggcatgtaccccaggtctaactggtggtacaacctggactcttggggccagggcacactggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5860 - DNA, 1884 bp, Artificial Sequence
  Synthetic Polynucleotide
atggccttaccagtgaccgccttgctcctgccgctggccttgctgctccacgccgccaggccgcagtctgtgctgacacagcctcctagtgtgtctggcgctcctggacagagagtgaccatcagctgtacaggcagcagcagcaatatcggagccggctatgacgtgcactggtatcagcagctgcctggcacagcccctaaactgctgatctacggcaacagcaacagacccagcggcgtgcccgatagattttccggctctaagagcggcacaagcgccagcctggctattactggactccaggccgaggacgaggccgactactactgtcagagctacgacagcagcctgagcggctctgtgtttggcacaggcacaaaggtgctggtgcttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggcagcagcgtgaaggtgtcctgcaaagcaagcggcggcaccttcagcagctacaccatcaacgtttggagacaggccccaggccagggccttgaatggatgggaggcttcatccctatcagcggcaccgtgaactacgcccagaaattccagggcagagtgacaatcaccgccgacgagagcacaagcaccgcctacatggaactgtccagcctgagaagcgaggacaccgccgtgtactactgtgccagacctctggattggaccgaggacatctggggccagggaacactggtcacagtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5861 - DNA, 1893 bp, Artificial Sequence
  Synthetic Polynucleotide
atggccttaccagtgaccgccttgctcctgccgctggccttgctgctccacgccgccaggccgaacttcatgctgacccagcctcacagcgtgtccgagtctccaggcaagaccgtgaccatcagctgtacaggcagcagcggctctatcgccagcaactacgtgcagtggtatcagcagaggccaggcagcgcccctaccatcctgatctacgaggataacaagcggcctagcggcgtgcccgatagattttctggcagcatcgacagcagcagcaacagcgccagcctgacaatcagcggcctgaaaacaggcgacgaggccgactactactgccagagctacgacgacatcaaccactgggttttcggcggaggcaccaagctgacagttcttggactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctggttcagagcggagccgaagtgaagaaacctggggcctctgtgaaggtgtcctgcaaggcttccggctacacctttaccgcctactacctgcactggctgagacaggctccaggccaaggactggaatggatgggctggatgaacaccaacaacggggccaccagatacgcccagaaattccaggacagagtgaccatgaccagagacaccagcatcaacaccgcctacatggaaatgagcggcctgtcctccgacgacaccgccatgtactattgtgccagaggcgacatcagccaggacttcgctgatgtgtggggccagggaacactggtcacagtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5862 - DNA, 1869 bp, Artificial Sequence
  Synthetic Polynucleotide
atggccttaccagtgaccgccttgctcctgccgctggccttgctgctccacgccgccaggccgcagatcgtgctgacacagagccctgccatcatgtccgcttctcccggcgagaaagtgaccatcacatgtagcgccagcagcagcgtgtcctacatgcactggttccagcagaagcccggcacaagccctaagctgtggatctacagcaccagcaatctggcctctggcgtgccagccagattttctggctctggcagcggcaccagctacagcctgacaatcagcagaatggaagccgaggacgccgccacctactactgtcagcagagaagcagctaccctcctacctttggcggaggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctccagcagagcggagccgagcttatgaagcctggcgcttccgtgaagatcagctgcaaggccaccggctacaccttcagcagctactggatcgagtgggtcaagcagaggcccggacatggcctggaatggatcggagagatcctgcctggaagcggcagcaccaactacaacgagaagttcaagggcaaagccaccttcaccgccgacaccagcagcaacacagcctatatgcagctgagcagcctgaccagcgaggacagcgccgtgtactactgcgccagatacgactacccttggtttgcctattggggccagggcaccctggttacagtttctgctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5863 - DNA, 1893 bp, Artificial Sequence
  Synthetic Polynucleotide
atggccttaccagtgaccgccttgctcctgccgctggccttgctgctccacgccgccaggccggacatcgtgatgacacagagccctagcagcctgacagtgacagccggcgagaaagtgaccatgagctgcaagagcagccagagcctgctgaacagcggcaaccagaagaactacctgacctggtatcagcagaagcccggccagcctcctaagctgctgatctactgggccagcaccagagaaagcggcgtgcccgatagattcacaggcagcggcagcggaaccgacttcaccctgacaatcagctctgtgcaggccgaggatctggccgtgtactactgccagaacgactacagctaccccttcacctttggctccggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcaacagcctggggccgaactcgttagacctggcgcttctgtgaagctgtcctgcaaggccagcggctacacctttaccagctactggatcaactgggtcaagcagcggcctggacagggcctcgaatggatcggcaatatctaccccagcgacagctacaccaactacaatcagaagttcaaggacaaggccacactgaccgtggacaagtctagcagcaccgcctacatgcagctgagcagccctacaagcgaggacagcgccgtgtattattgcacccggtcttggcggggcaacagcttcgattattggggccagggcacaaccctgaccgtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5864 - DNA, 1887 bp, Artificial Sequence
  Synthetic Polynucleotide
atggccttaccagtgaccgccttgctcctgccgctggccttgctgctccacgccgccaggccggacacccagatgacacagagccctagtagcgtgtccgccagcgtgggagacagagtgaccatcacctgtagaaccagccaggacatcagcaactacctgaactggtatcagcagaagcccggcaaggcccctaagctgctgatctacaacaccagcagactgcacagcggcgtgcccagcagattttctggctctggcagcggcaccgacttcaccctgacaatatctagcctccagcctgaggacttcgccacctactactgccagcagagcaacatgttcccctacaccttcggccagggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggcttccggctacacctttaacggctacttcatgaactgggtccgacaggctcctggacagggcctcgaaagaatgggcagaatcaaccccaacaacggcgacagcttctacaaccagaaattccagggccgcgtgaccatgaccagagacaccagcacaagcaccgtgtacatggaactgcctagcctgagaagcgaggacaccgccgtgtactactgtgccagagagggctattacggcggcagaggctacgccctggattattggggacagggcacactggtcaccgtgtctagtacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5865 - DNA, 1884 bp, Artificial Sequence
  Synthetic Polynucleotide
atggccttaccagtgaccgccttgctcctgccgctggccttgctgctccacgccgccaggccgcagtctgtggtcacacagcctccatccgtgtctgctgcccctggacagaaagtgaccatcagctgtagcggcagcagcagcaacatcggcaacaactacgtgtcctggtatcagcagctgcccggcacagctcccaaactgctgatctacgacaacaacaagcggcccagcggcatccccgatagattttctgccagcaagagcggcaccagcgccacactgggaatcacaggactccagaccagagatgaggccgactactactgcggcacctgggattcttctctgtccgcctgggttttcggcggaggcacaaaactgacagtgctcggactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagtctggggccgaagtgaagaaacctggcagcagcgtgaaggtgtcctgcaaggcttccggcgataccttcagcagctactacatcagctgggtccgacaggccccaggacaaggacttgagtggatgggcagaatcatccccatcctgggaatcgccaactacgcccagaaataccagggcagagtgaccctgagcgccgacaagagcacaagcaccagctacatggaactgaacagcctgagcagcgaggacaccgccgtgtactattgtgccctggactggtcctacagcatcgactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5866 - DNA, 1893 bp, Artificial Sequence
  Synthetic Polynucleotide
atggccttaccagtgaccgccttgctcctgccgctggccttgctgctccacgccgccaggccggagctggtcatgacacagagccctgcttctctggccgtgtcactgggacagagagccaccatctcttgcagagccagcgagagcgtggacagctacggcaagagcttcatgcactggtatcagctcaagcccggccagcctcctaagctgctgatctacagagcctccaacctggaaagcggcgtgccagccagattttctggcagcggcagcagaaccgacttcaccctgaccattgatcccgtggaagccgatgatgccgccacctactactgccagcagaacaacgaggacccctggacatttggcggaggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctcgaacagtctggccccgagcttgtgaaacctggcgcttccgtgaagatgagctgcaaggccagcggctacaccttcaccaactactacatgaaatgggtcaagcagagccacggcaagtccctggaatggatcggcgatctgaaccccaacaacggcgacaccttctacaaccagaagttcaagggcaaagccacactgaccgtggacaagagcagcaacaccgcctacatgcagctcaactccctgaccagcgaggacagcgccgtgtactactgtgccagaaccggcagatacgaagagaacgctatggactactggggccagggcacaagcgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5867 - DNA, 1875 bp, Artificial Sequence
  Synthetic Polynucleotide
atggccttaccagtgaccgccttgctcctgccgctggccttgctgctccacgccgccaggccggacgtggtcatgacacagagcccttctagcctgtctgccagcgtgggcgacagagtgaccatcacctgtatggcctccgaggacatctacatccggctggcctggtatcagcagaagcctggaaacgcccctaagctgctgatctacgccgccacctctctggaaacaggcgtgccaagcagattttccggcagcggctctggcaccgatttcaccctgacaatatccagcctccagcctgaggacttcgccacctactactgccagcagtattggagcagcccctggacatttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctgcaagagtctggccccggactggtcaagcctagccaaacactgagcctgacctgtaccgtgtccggctacagcatcaccagcgactacacctggaactggatcagacagcctcctggcaacggactggaatggatcggctacatcacctacagcggcagcaccagctacaaccccagcctgaaaagccgggtgctgatctccgtggacaccagcaagaatcaggtgtccctgaagctgagcagcgtgacagccgctgataccgccgtgtactactgtgccagactggggagaagatacacaatggactactggggccagggcaccaccgtgacagtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5868 - DNA, 1896 bp, Artificial Sequence
  Synthetic Polynucleotide
atggccttaccagtgaccgccttgctcctgccgctggccttgctgctccacgccgccaggccggacgtgctgatgacccagacacctgtgtctctgtccgtgtctctgggagatcaggccagcatctcctgtagaagcagccagagcatcgtgcacagcaccggcaacacctacctggaatggtatctccagaagcctggacagagccccaagctgctgatctacaagatcagcaacagattcagcggcgtgcccgacagattttctggcagcggctctggcaccgacttcaccctgaagattagcagagtggaagccgaggacctgggcgtgtactactgcttccaagcctctcacgcccctagaacctttggcggaggcaccaagctggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgatcctggtggaaagcggaggcggccttgtgaaacctggcggatctctgaagctgagctgtgccgccagcggcttcacctttagcagctacacaatgagctgggtccgacagacccctgagaagagactggaatgggtcgccaccatctcttccggcggagggaacacctactatcccgactctgtgaagggcagattcaccatcagccgggacaacgccaagaacaacctgtacctccagatgagcagcctgcggagcgaagatacagccctgtactattgcgcccggtactacagatacgaggcttggtttgcctcttggggccagggcacactggttacagtttctgctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5869 - DNA, 1887 bp, Artificial Sequence; identical to SEQ ID NO: 5803
  Synthetic Polynucleotide

SEQ ID NO: 5870 - DNA, 1890 bp, Artificial Sequence
  Synthetic Polynucleotide
atggccttaccagtgaccgccttgctcctgccgctggccttgctgctccacgccgccaggccggacatccagctgactcagagccctagctttctgagcgccagcgtgggcgacagagtgaccattacatgtagagccagccagggcatcagcaccgacctgaactggtatcagcagaagcctggcaaggcccctaagctgctgatctacgccgccagcaatctggaaagcggcgtgccaagcagattttccggctctggcagcggcaccgagttcaccctgacaatatctagcctccagcctgaggacttcgccacctactactgccagcagagctacaactggccctacacctttggcggaggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctggttgaatcaggcggaggactcgtgaaacctggcggctctctgagactgtcttgtgccgccagcggcttcaccttcagcaacttcgagatgaactgggtccgacaggccccaggcaaaggactggaatgggtgtccggcatcagctccaatggccggtacatcaactacgccgacagcgtgaagggcagattcaccatcagccgggacaacgccaagaacagcctgtacctccagatgaactccctgagagccgaggacaccgccgtgtactattgtgccagagtggtggacttcgaccaggactacaacggcttcgactattggggccagggcaccctggttaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5871 - DNA, 1884 bp, Artificial Sequence
  Synthetic Polynucleotide
atggccttaccagtgaccgccttgctcctgccgctggccttgctgctccacgccgccaggccggacatccaactgactcagagccccagctttctgagcgcctctgtgggcgacagagtgaccatcacatgtagtctcagcctgggcatcagcacatggcgggattggtttccgccgaggcttggcaggggccttgagccgctgacctacgccgccagcacactgcaaagcggagtgcctagcagattttccggcagcggctctggcaccgagttcaccctgacaatatccagcctccagcctgaggacttcgccacctactactgccagcagctcaacagctaccctctgacctttggcggaggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcaactggttgagtctggtggcggcctggttaagcctggcggatctctgagactgagctgtgccgccagcggcttcacctttagcacatacggcatgagctgggtccgacaggcccctggaaaaggacttgagtgggtcgcctacatcaacaacggctccggctacatctactacgccgacagcgtgaagggcagattcaccatcagccgggacaacgccaagaacagcctgtacctccagatgaactccctgagagccgaggacaccgccgtgtactattgtgccagaggacagtggtggagcggcggagactttgattattggggccagggcaccctggtcaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5872 - DNA, 1887 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgtactggtatcagcagaagcccggacaggcccctagactgctgatctacagaaccagcaacctggcctctggcatccccgccagattttctggctctggcagcggcaccgatttcaccctgaccataagcagcctggaacctgaggacttcgccgtgtactactgccagcagtaccacagctaccccaccacctttggacagggcaccaaggtggaaatcaagcggacagttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaatcaggtggcggcctggttcaacctggcggatctctgagactgtcttgtgccgccagcggcttcagcttcaacacctacgccatgaactgggtccgacaggctcctggcaaaggactggaatgggtgtcccacatcagaagcaagagcaacaacttcgccacctactacgccgacagcgtgaaggacagattcaccatcagccgggacaacgccaagaacagcctgtacctccagatgaactccctgagagccgaggacaccgccgtgtattattgcgccagacaaggcggcgacttccctatggattattggggccagggcaccctggtcaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5873 - DNA, 1875 bp, Artificial Sequence
  Synthetic Polynucleotide
atggccttaccagtgaccgccttgctcctgccgctggccttgctgctccacgccgccaggccggacgtggtcatgacacagagcccttctagcctgtctgccagcgtgggcgacagagtgaccatcacctgtaaagccagcgaggacatctacatccggctggcctggtatcagcagaagcctggaaaggcccctaagctgctgatctacgccgccacctctctggaaacaggcgtgccaagcagattttccggcagcggctctggcaccgatttcaccctgacaatatccagcctccagcctgaggacttcgccacctactactgccagcagtattggaccacaccttggacctttggcggaggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctccaagagtctggccctggactggtcaagcctagccagacactgagcctgacctgtaccgtgtccggctacagcatcaccatcgactacacctggaactggatcagacagcctcctggcaaaggactggaatggatcggctacatcacctacagcggcagcaccgactacaaccccagcctgaaaagccgggtgctgatctccgtggacaccagcaagaatcaggtgtccctgaagctgagcagcgtgacagccgctgataccgccgtgtactactgtgccagactgggcagaagatacgccctggattattggggccagggcaccaccgtgacagtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5874 - DNA, 1881 bp, Artificial Sequence
  Synthetic Polynucleotide
atggccttaccagtgaccgccttgctcctgccgctggccttgctgctccacgccgccaggccggacgtggtcatgacacagagcccttctagcctgtctgccagcgtgggcgacagagtgaccatcacatgtagagccagccaggacatcagcaagtacctgaactggtatcagcagaagcccggcaaggcccctaagctgctgatctaccacaccagcagactgcacagcggcgtgccaagcagattttctggcagcggctctggcaccgacttcaccctgacaatatccagcctccagcctgaggacttcgccacctactattgccagcagggcaacaccctgccttacacctttggcggcggaacaaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcaagagtctggccctggcctggtcaagcctagccaaacactgagcctgacctgtaccgtcagcggagtgtccctgcctgattatggcgtgtcctggatcagacagcctcctggcaaaggactggaatggatcggcgtgatctggggcagcgagacaacctactacaacagcgccctgaagtccagagtgctgatctccgtggacaccagcaagaaccaggtgtccctgaagctgagcagcgtgacagccgctgataccgccgtgtactactgcgccagacactactactacggcggcagctacgctatggactattggggccagggcaccaccgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5875 - DNA, 1887 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgacagagtgaccatctcttgtagagccagccaggacatcagcaactacctgaactggtatcagcagaaacccgacggcaccgtgaagctgctgatctactacaccagcatcctgcacagcggcgtgcccagcagattttctggctctggcagcggcaccgactacagcctgaccatcagcaatctggaacaagaggacttcgctacctacttctgccagcaaggcaacaccctgccttggacatttggcggaggcaccaagctggaaatcaaagctctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagtgcaactggttgaatctggcggcggactggttaagcctggcggatctctgaagctgagctgtgccgcctctggcttcgccttcagcatctacgatatgagctgggtccgacagacccctgagaagagactggaatgggtcgcctacatctctagcggcggagggacctactatcccgacacagtgaagggcagattcaccatctccagagacaacgccaagaacaccctgtacctccagatgagcagcctgaagtccgaggacaccgccatgtactactgcgccagacacagcggctatggcacacattggggagtgctgtttgcctactggggccagggaacactggtcacagtttctgctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5876 - DNA, 1920 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagagcctgctgtacagaagcaaccagaagaactacctggcctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagcagtattacaactaccccagaaccttcggccagggcaccaaggtggaaatcaagagaacagttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatcaggcggcggactggttcaacctggcggatctctgagactgagctgtgccgccagcggctacagcatcacaagcgactatgcctggaactgggtccgacaggcccctggcaaaggactggaatgggtgtcctacatcagcaacagcggcagcaccagctacaaccccagcctgaagtcccggttcaccatcagcagagacaacagcaagaacaccctgtacctccagatgaacagcctgagagctgaggacaccgccgtgtattattgcgccaaagagcggaactacgactacgacgattactactacgctatggactactggggccagggaaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5877 - DNA, 1899 bp, Artificial Sequence
  Synthetic Polynucleotide
atggccttaccagtgaccgccttgctcctgccgctggccttgctgctccacgccgccaggccggacgtggtcatgacacagagccctctgagcctgcctgtgacacttggacagcctgccagcatcagctgtagaagcagccagagcctgctgcacagcagcggcaatacctacctggaatggtatcagcagaggcccggacagagccccagacctctgatctacaagatcagcacccggttcagcggcgtgcccgatagattttctggctctggcagcggcaccgacttcaccctgaagattagcagagtggaagccgaggacgtgggcgtgtactactgcttccaaggcagccacgtgccatacacctttggcggcggaacaaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaagcctctggcctgaccatcgaggactactacatgcactgggtccgacaggcccctggacaaggacttgaatggatgggctggatcgaccccgagaacggcgatacagagtacggccctaagttccagggcagagtgaccatgaccagagacaccagcatcaacaccgcctacatggaactgagccggctgagatccgatgacaccgccgtgtactattgcgccgtgcacaatgcccactacggcacttggtttgcctattggggccagggcacactggtcaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5878 - DNA, 1875 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcgagaacatctacagcaacctggcctggtatcagcagaagcctggcaaggcccctaagctgctgatctacgccgccaccaatctggctgatggcgtgccaagcagattttccggctctggcagcggcaccgatttcaccctgacaatatccagcctccagcctgaggacttcgccacctactactgccagcacttttggggcacccctacattcggccagggcaccaaggtggaaatcaagagaacagttctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcagcctgacaaattacggcgtgcactgggtccgacaggcccctggaaaaggactggaatgggtgtccgtgatttggagcggcggcagcaccgattacaacgccgccttcatcagccggttcaccatcagcgccgacaccagcaagaataccgcctacctccagatgaactccctgagagccgaggacaccgccgtgtactattgcgccagagaactgatccacgctatggacaactggggccagggaaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5879 - DNA, 1896 bp, Artificial Sequence
  Synthetic Polynucleotide
atggccttaccagtgaccgccttgctcctgccgctggccttgctgctccacgccgccaggccggacttcgtgatgacacagagccctctgagcctgcctgtgacacctggcgaacctgccagcatcagctgtagaagcagccagagcatcgtgcacagcaacggcaacacctacctggaatggtatctccagaagcctggacagagcccacagctgctgatctacaaggtgtccaacagattcagcggcgtgcccgacagattttctggcagcggctctggcaccgacttcaccctgaagattagcagagtggaagccgaggacgtgggcgtgtactactgcttccaaggctctcacgtgcccctgacctttggacagggcaccaagctggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaaagcggagccgaagtgaagaaacctggggcctctgtgaaggtgtcctgcaaggccagcggctacacctttaccagctactggattcactgggtccgacaggcccctggacaaggacttgagtggatgggcgagaacgacccctccaacggcaggaccaactacaacgagaagttcaagaaccgcgtgaccctgaccgtggacaccagcatctctaccgcctacatggaactgagccggctgagatccgatgacaccgccgtgtactattgcgccagaggacccaactacttttacagcatggactactggggccagggcacaatggtcaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5880 - DNA, 1875 bp, Artificial Sequence
  Synthetic Polynucleotide
atggccttaccagtgaccgccttgctcctgccgctggccttgctgctccacgccgccaggccggacatccagctgactcagagccctagctttctgagcgccagcgtgggcgacagagtgaccatcacatgtagcgccagatccagcatcagcttcatgtactggtatcagcagaagcccggcaaggcccctaagctgctgatctacgacaccagcaatctggcctctggcgtgcccagcagattttctggaagcggcagcggcaccgagttcaccctgacaatctctagcctggaagccgaggatgccgccacctactattgccagcagtggtccagctatcccctgacatttggacagggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccggctcttggatgaactgggtccgacaggctcctggacagggactcgaatggatcggcagaatctatcctggcgacggcgagacaaactacaacggcaagttcaaggaccgcgtgacaatcaccgccgacaagagcacaagcaccgcctacatggaactgagcagcctgcggagcgaagataccgccgtgtactactgcgcccggatctacggcaacaacgtgtacttcgatgtgtggggccagggcacaaccgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5881 - DNA, 1899 bp, Artificial Sequence
  Synthetic Polynucleotide
atggccttaccagtgaccgccttgctcctgccgctggccttgctgctccacgccgccaggccgcagctggtgctgacacagtctccaagcgcctctgccagcctgggatctagcgtgaagctgacctgtacactgagcagcggccacaagaccgacaccatcgactggtatcagcagcagcctggcaaggcccctagatacctgatgaagctggaaggcagcggcagctacaacaaaggctctggcgtgcccgatagattcagcggcagttcttctggcgctgattggtatctgaccatcagcagcctccagagcgaggacgaggccgattactactgcggcacagactaccccggcaactacctgtttggcggcggaacacagctgacagtgcttggcctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagaacagctggttgaaagcggcggaggactggttcaacctggcggttctctgagactgagctgtgccgccagcggcttcaccttcagcgactactacatgagctggatcagacaggccccaggcaaaggactggaatgggtcgccacaatctaccccagcagcggcaagacctactacgccgattctgccaagggcagactgaccatctccagcgacaacgccaaggacagcctgtacctccagatgaacagcctgagagccgaggacaccgccgtgtactactgcaccagagatagctacgccgacgacgccgctctgtttgacatttggggccagggcaccaccgtgaccgtttcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5882 - DNA, 1889 bp, Artificial Sequence
  Synthetic Polynucleotide
atggccttaccagtgaccgccttgctcctgccgctggccttgctgctccacgccgccaggccggagattgtgttgacacagtctcccgataccctgtcactgtcacccggcgagaaggcaacgctgagttgcagagcaagccagtcagtctcctcttcttttctggcctggtatcagcaaaaaccaggtcaggcaccatctctcctgatttacgttgccagcagacgggcggctggcattcccgacaggttctctggaagcggatctgggaccgattttaccctgacaattagccgcttggagcccgaagactttggtatgttttactgccagcactacggaaggacacctttcacatttggcccgggcacgaaagtcgatataaaacgcgcctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacagatccagttggtggaatcagggggcggtgtggtgcagccgggtaggagcctgagactgtcatgcgtggcgtctggcttcacattcaagaactacggcatgcactgggtgcgacaggcccccggaaagggtttggagtgggtcgccgtgatctggtacgacggatctaatgagtattacggagatcctgtgaagggaaggttcaccatctcccgcgacaatagcaaaaatatgctctacctgcaaatgaactcactcagggcggatgatacggcggtctactattgcgctcgctcagggattgctgtggccggcgcattcgattactggggacagggtaccctggtgacagtatcaagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5883 - DNA, 1905 bp, Artificial Sequence
  Synthetic Polynucleotide
atggccttaccagtgaccgccttgctcctgccgctggccttgctgctccacgccgccaggccggacattcagatgacccaaagcccgtccagcctgtccgccagcctgggagatagagtgacaatcacgtgtagagcttcccaagggataagaaatgatctcgggtggtatcagcagaagcccggcaaagcccccaaaaggcttatatatgctagtagtacactgcagtctggagttccttcccgattttcaggtagcggctccggtacagagttcaccctcacgataagctcactccagcctgaggatttcgcaacgtactactgcctccagcacaacaattttccctggactttcggccagggcaccaaggtggagatcaagaggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttactttgaaggagtctggacctgtactggtgaagccaaccgagacactgacactcacgtgtacagtgagtggtttttccttgatcaacgcaaggatgggcgtcagctggatcaggcaaccccctggcaaggctctggaatggctcgctcacatattcagcaatgccgaaaaaagctaccggacaagcctgaaatcccgcctgactatttccaaggacacttctaagtctcaggtggtgctgaccatgaccaacatggacccggtggacaccgccacctattactgcgcaagaatccctgggtatggtgggaatggtgactaccattattatgggatggatgtgtgggggcaaggcacaaccgtaacggtctcaagcacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5884 - DNA, 1875 bp, Artificial Sequence
  Synthetic Polynucleotide
atggccttaccagtgaccgccttgctcctgccgctggccttgctgctccacgccgccaggccggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtacgccgcctaccctacttttggcggagggaccaaggttgagatcaaacggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctggtggtggtagcacaagctacgcacagaagttccagggcagagtcaccatgaccagggacacgtccacgagcacagtctacatggagctgagcagcctgagatctgaggacacggcggtgtactactgcgccagagagagttggcgatacgccctggattattggggccagggcaccaccgtgacagtgtcatctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5885 - DNA, 1875 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagaatctcctggcctttcacttttggcggagggaccaaggttgagatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggcggtgtactactgcgcaagagccgagatgggagccgtattcgacatatggggtcagggtacaatggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5886 - DNA, 1890 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagacacgtctggcctcctacttttggcggagggaccaaggttgagatcaaacggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacagctgcagctgcaggagtcgggcccaggactggtgaagccttcggagaccctgtccctcacctgcactgtctctggtggctccatcagcagtagtagttactactggggctggatccgccagcccccagggaaggggctggagtggattgggagtatctcctatagtgggagcacctactacaacccgtccctcaagagtcgagtcaccatatccgtagacacgtccaagaaccagttctccctgaagctgagttctgtgaccgccgcagacacggcggtgtactactgcgccagaggcaggggatatgcaaccagcttagccttcgatatctggggtcagggtacaatggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5887 - DNA, 1905 bp, Artificial Sequence
  Synthetic Polynucleotide
atggccttaccagtgaccgccttgctcctgccgctggccttgctgctccacgccgccaggccggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcagggactcggcctccctctcacttttggcggagggaccaaggttgagatcaaacggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgccagagacggtacttatctaggtggtctctggtacttcgacttatgggggagaggtaccttggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5888 - DNA, 1920 bp, Artificial Sequence
  Synthetic Polynucleotide
atggccttaccagtgaccgccttgctcctgccgctggccttgctgctccacgccgccaggccggacatcgtgatgacccagtctccagactccctggctgtgtctctgggcgagagggccaccatcaactgcaagtccagccagagtgttttatacagctccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcagttcgcccacactcctttcacttttggcggagggaccaaggttgagatcaaacggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggcggtgtactactgcgccagaactcctgaatactcctccagcatatggcactattactacggcatggacgtatggggccagggaacaactgtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5889 - DNA, 1893 bp, Artificial Sequence
  Synthetic Polynucleotide
atggccttaccagtgaccgccttgctcctgccgctggccttgctgctccacgccgccaggccggaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatagcgcatccaccagggccactggtatcccagccaggttcagtggcagtgggtctgggacagagttcactctcaccatcagcagcctgcagtctgaagattttgcagtttattactgtcagcagcaccacgtctggcctctcacttttggcggagggaccaaggttgagatcaaacggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatcgtatgatggaagtaataaatactatgcagactccgtgaagggccgattcaccatctccagagacaattccaagaacacgctgtatctgcaaatgaacagcctgagagccgaggacacggcggtgtactactgcgtcaaggggccgttgcaggagccgccatacgattatggaatggacgtatggggccagggaacaactgtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5890 - DNA, 1881 bp, Artificial Sequence
  Synthetic Polynucleotide
atggccttaccagtgaccgccttgctcctgccgctggccttgctgctccacgccgccaggccggaaattgtgttgacacagtctccagccaccctgtctttgtctccaggggaaagagccaccctctcctgcagggccagtcagagtgttagcaggtacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagagattctactacccttggacttttggcggagggaccaaggttgagatcaaacggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggtgcagctggtggagtctgggggaggcttggtacagcctggggggtccctgagactctcctgtgcagcctctggattcaccttcagtagctatagcatgaactgggtccgccaggctccagggaaggggctggagtgggtttcaaccattagtagtagtagtagtaccatatactacgcagactctgtgaagggccgattcaccatctccagagacaatgccaagaactcactgtatctgcaaatgaacagcctgagagctgaggacacggcggtgtactactgcgccagaggttctcaggagcacctgattttcgattattggggacagggtacattggtcaccgtctcctcaacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5891 - DNA, 1884 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5892 - DNA, 1890 bp, Artificial Sequence
  Synthetic Polynucleotide
atggccttaccagtgaccgccttgctcctgccgctggccttgctgctccacgccgccaggccggatattcaactgacacaatcccccagctcactcagcgccagcgtgggggacagggttagctttacctgtcaagcctctcaggatataaataactttctgaactggtatcaacagaagcctgggaaggcgcccaaactcctgatctatgatgcgtccaacctggaaactggcgtgccttcacgctttagcggctctggcagtggtacagacttcacttttaccatctcttcacttcagccggaggacatcgccacatattactgtcaacagtacggaaacttgccctttacttttggaggcggcaccaaagttgaaatcaaaagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtccaactgcaagaaagcggacccggactggtgaagccttctgagacacttagtctgacgtgcacggtcagtggcggctccatctcctcctattattggtcatggatacgacaacccccaggtaagggcctggaatggattggctatatctactattcaggaagcacgaactacaatcccagcctgaagtcccgagtgacaatttcagtagataccagtaaaaaccagttcagtcttaaactgtcaagcgtgacagctgccgacaccgctgtgtattactgcgtctcactggtgtattgtggaggggattgttatagcgggttcgattattggggacagggaaccctggtgactgtatcttccacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5893 - DNA, 1896 bp, Artificial Sequence
  Synthetic Polynucleotide
atggccttaccagtgaccgccttgctcctgccgctggccttgctgctccacgccgccaggccggatatccagctcactcaaagcccctctagtctctctgcctcagtgggggatcgggtcagttttacttgtcaagcttcacaggatatcaacaacttccttaattggtatcagcagaagccaggaaaagcacccaagctgctcatctatgatgcctcaaatttggagacgggtgttcccagtcgattctctgggtcagggtccgggaccgactttacgtttacgatctcctctctgcagcccgaagacatcgccacatactattgtcaacagtacggcaacttgcctttcacatttgggggcgggactaaggttgaaatcaagaggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggtacagctgcaggaatctgggcccggacttgtcaagccaagtcagacactttctcttacatgtaccgtgagcggcggaagtataagcagtggaggcttttactggtcttggatacggcagcacccaggcaaaggcttggagtggattggatacattcatcattcaggatctacacactataatccatcccttaagtcccgggtcaccattagcattgatacgtctaagaatctgttcagtctcaggctgtcctccgtcactgctgccgacacagccgtgtactactgcgcctccttggtttactgcggaggcgactgttatagcggctttgattattgggggcaggggaccctcgtaaccgtgagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5894 - DNA, 1884 bp, Artificial Sequence
  Synthetic Polynucleotide
atggccttaccagtgaccgccttgctcctgccgctggccttgctgctccacgccgccaggccggacattcagatgacacagagccctagcagcctgagcgcctctgtgggagacagagtgaccatcacatgcaagagcagccagagcgtgctgtactccagcaatcagaagaactacctggcctggttccagcagaagcctggcaaggctcctaagctgctgatctactgggccagcaccagagaaagcggcgtgccaagcagattttctggcagcggctctggcaccgacttcaccctgacaatatccagcctccagcctgaggacttcgccacctacttttgccaccagtacctgagcagctacacattcggacagggcaccaaggtggaaatcaagcggctcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggctacaccttcaccacctattggatgcactgggtccgacaggcccctggcaaaggacttgagtgggtcggatatatcaggcccagcaccggctacacagagtacaaccagaagttcaaggaccgcttcaccatcagcgccgacaccagcaagaataccgcctacctccagatgaacagcctgagagccgaggacaccgccgtgtactactgtgccagatccagatggctgctggactattggggccagggcacactggttacagtttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5895 - DNA, 1875 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagccaggacatcagcaactacctgaactggtatcagcagaagcccggcaaggcccctaagctgctgatctactacaccagcagactgcacagcggcgtgcccagcagattttctggctctggcagcggcaccgacttcaccctgacaatatctagcctccagcctgaggacttcgccacctactattgccagcagggcaacaccctgccttacacatttggacagggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaatcaggtggcggcctggttcaacctggcggatctctgagactgagctgtgccgccagcggcttcaccttcagcgactactttatgagctgggtccgacaggcccctggcaaaggacttgaatgggtcgccaccatcagcaatggcggcacctacacttactaccccgacagcgtgaagggcagattcaccatctccagagacaacagcaagaacaccctgtacctccagatgaactccctgagagccgaggacaccgccgtgtactactgcgccagattcgacggctacatcttcgactattggggccagggcaccctggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5896 - DNA, 1878 bp, Artificial Sequence
  Synthetic Polynucleotide
atggccttaccagtgaccgccttgctcctgccgctggccttgctgctccacgccgccaggccggagatcgtgctgacacagtctcccgccacactgtcactgtctccaggcgaaagagccacactgagctgtagcgccagcagcagcgtgtcctacatgcactggtatcagcagaagcccggacaggcccctagactgctgatctacgataccagcaagctggcctctgacatccccgccagattttctggcagcggctctggcaccgatttcaccctgaccataagcagcctggaacctgaggacttcgccgtgtactactgtcagcagggcagcgtgtaccccttcacatttggcggcggaacaaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcaagagtctggccctggcctggttaagcctagcggaacactgagcctgacctgtgctgtgtctggcggcagcatcagcacatctggcatgggcgttggctgggtccgacagcctcctggaaaaggcctggaatggatcggccacatttggtgggacgacgacaagcggtacaaccccgctctgaagtccagagtgaccatcagcgtggacaagagcaagaaccagttcagcctgcggctgagcagcgtgacagctgcagataccgccgtgtattattgcgcccggatggaactgtggtcctactacttcgactactggggcaagggcaccaccgtgactgtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5897 - DNA, 1896 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtaccgccagcagcagagtgtccagcagctacctgcactggttccagcagaagcctggcaaggcccctaagctgctgatctacagcaccagcaatctggcctctggcgtgcccagcagattttctggctctggcagcggcaccgacttcaccctgacaatatctagcctccagcctgaggacttcgccacctactactgccaccagtaccacagaagcccctacacattcggccagggcaccaaggtggaaatcaagagactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctggttgaatctggcggcggactggttcaacctggcggatctctgagactgagctgtgccgcctctggctacgccttcagcaacagctggatcaactgggtccgacaggcccctggcaaaggactggaatgggtcggacaaatctaccccggcgactacgacaccaactacaacggcaagttcaagggcagattcaccatcagccgggacaagagcaagaacaccgcctacctccagatgaactccctgagagccgaggacaccgccgtgtactattgtgctagaggcggctccatctactacggcaacctgggcttcttcgacgtgtggggacagggcacactggtcacagtctcttctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5898 - DNA, 1866 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgtagcgccagcagcagcgtgacctacatgtactggtatcagcagaagcccggcaaggcccctaagctgctgatctacgacaccagcaatctggcctctggcgtgcccagcagattttctggctctggcagcggcaccgactacaccctgacaatatctagcctccagcctgaggacttcgccacctactactgccagcagtggtccaactatcccctgacattcggccagggcaccaaggtggaaatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacagcttcatcgagtacaccatcaactgggtccgacaggcccctggacaaggcctggaatggatcggcaacatcgacccctactacggcacaacctactacaaccagatgttcaccggcagagccacactgaccgtggacacctctatcagcaccgcctacatggaactgagccggctgagatccgatgacaccgccgtgtactattgtgccagaggcagcgcctggtttccctattggggacagggaaccctggtcaccgttagctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5899 - DNA, 1866 bp, Artificial Sequence
  Synthetic Polynucleotide
atggccttaccagtgaccgccttgctcctgccgctggccttgctgctccacgccgccaggccggagatcgtgctgacacagagcccttctagcctgtctgccagcgtgggcgacagagtgaccatcacatgtagagccagcgagaacatctacagctacctggcctggtatcagcagaagcctggcaaggcccctaagctgctgatctacaacaccaagacactcggcgagggcgtgcccagcagattttctggttctggcagcggcaccgacttcaccctgaccatatctagcctgcagcctgaggacttcgccacctactactgccagcaccactacggcacccctttcacatttggccctggcaccaaggtggacatcaaactcgaggcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccctgtttgccctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacaccttcagcgactattgggtgcactgggtccgacaggctccaggacaaggactggaatggatgggagccatcgacggcagcgataccttcaacgattacagccagaaattcaaaggccgcgtgaccatgaccagagacaccagcatcagcaccgcctacatggaactgagccggctgagatccgatgacaccgccgtgtactattgtgccagaggcggcctgctgcagtattggggacagggaacactggtcaccgtgtcctctacgcgtggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 5900 - protein, 21 aa, Artificial Sequence
  Synthetic Polypeptide
MLLLVTSLLLCELPHPAFLLI

SEQ ID NO: 5901 - protein, 21 aa, Artificial Sequence
  Synthetic Polypeptide
MALPVTALLLPLALLLHAARP

SEQ ID NO: 5902 - protein, 21 aa, Artificial Sequence
  Synthetic Polypeptide
MALPVTALLLPLALLLHAARP

SEQ ID NO: 5903 - protein, 21 aa, Artificial Sequence
  Synthetic Polypeptide
MALPVTALLLPLALLLHAARP

SEQ ID NO: 5904 - protein, 19 aa, Artificial Sequence
  Synthetic Polypeptide
MDWIWRILFLVGAATGAHS

SEQ ID NO: 5905 - protein, 19 aa, Artificial Sequence
  Synthetic Polypeptide
MDWIWRILFLVGAATGAHS

SEQ ID NO: 5906 - protein, 15 aa, Artificial Sequence
  Synthetic Polypeptide
GGGGSGGGGSGGGGS

SEQ ID NO: 5907 - protein, 35 aa, Artificial Sequence
  Synthetic Polypeptide
GGGGSGGGGSGGGGSGSGGSGSGGSGSGGSGSGGS

SEQ ID NO: 5908 - protein, 12 aa, Artificial Sequence
  Synthetic Polypeptide
EQKLISEEDGSG

SEQ ID NO: 5909 - protein, 12 aa, Artificial Sequence
  Synthetic Polypeptide
EQKLISEEDGSG

SEQ ID NO: 5910 - protein, 13 aa, Artificial Sequence
  Synthetic Polypeptide
EQKLISEEDLGSG

SEQ ID NO: 5911 - protein, 13 aa, Artificial Sequence
  Synthetic Polypeptide
EQKLISEEDLGSG

SEQ ID NO: 5912 - protein, 13 aa, Artificial Sequence
  Synthetic Polypeptide
EQKLISEEDLGSG

SEQ ID NO: 5913 - protein, 17 aa, Artificial Sequence
  Synthetic Polypeptide
GKPIPNPLLGLDSTGSG

SEQ ID NO: 5914 - protein, 12 aa, Artificial Sequence
  Synthetic Polypeptide
YPYDVPDYAGSG

SEQ ID NO: 5915 - protein, 9 aa, Artificial Sequence
  Synthetic Polypeptide
HHHHHHGSG

SEQ ID NO: 5916 - protein, 15 aa, Artificial Sequence
  Synthetic Polypeptide
GLNDIFEAQKIEWHE

SEQ ID NO: 5917 - protein, 13 aa, Artificial Sequence
  Synthetic Polypeptide
GSGGGGSGGGGSG

SEQ ID NO: 5918 - protein, 13 aa, Artificial Sequence
  Synthetic Polypeptide
GSGGGGSGGGGSG

SEQ ID NO: 5919 - protein, 11 aa, Artificial Sequence
  Synthetic Polypeptide
WSHPQFEKGSG

SEQ ID NO: 5920 - protein, 11 aa, Artificial Sequence
  Synthetic Polypeptide
WSHPQFEKGSG

SEQ ID NO: 5921 - protein, 11 aa, Artificial Sequence
  Synthetic Polypeptide
DYKDDDDKGQR

SEQ ID NO: 5922 - protein, 12 aa, Artificial Sequence
  Synthetic Polypeptide
ELPTQGTFSNVS

SEQ ID NO: 5923 - skipped

SEQ ID NO: 5924 - protein, 106 aa, Artificial Sequence
  Synthetic Polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 5925 - protein, 103 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 5926 - protein, 101 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERK

SEQ ID NO: 5927 - protein, 102 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKC

SEQ ID NO: 5928 - protein, 103 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCC

SEQ ID NO: 5929 - protein, 103 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYG

SEQ ID NO: 5930 - protein, 121 aa, Artificial Sequence
  Synthetic Polypeptide
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPS

SEQ ID NO: 5931 - protein, 108 aa, Artificial Sequence
  Synthetic Polypeptide
ASPTSPKVFPLSLDSTPQDGNVVVACLVQGFFPQEPLSVTWSESGQNVTARNFPPSQDASGDLYTTSSQLTLPATQCPDGKSVTCHVKHYTNPSQDVTVPCPVPPPPP

SEQ ID NO: 5932 - protein, 159 aa, Artificial Sequence
  Synthetic Polypeptide
APTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTP

SEQ ID NO: 5933 - protein, 103 aa, Artificial Sequence
  Synthetic Polypeptide
ASTQSPSVFPLTRCCKNIPSNATSVTLGCLATGYFPEPVMVTWDTGSLNGTTMTLPATTLTLSGHYATISLLTVSGAWAKQMFTCRVAHTPSSTDWVDNKTFS

SEQ ID NO: 5934 - protein, 104 aa, Artificial Sequence
  Synthetic Polypeptide
GSASAPTLFPLVSCENSPSDTSSVAVGCLAQDFLPDSITLSWKYKNNSDISSTRGFPSVLRGGKYAATSQVLLPSKDVMQGTDEHVVCKVQHPNGNKEKNVPLP

SEQ ID NO: 5935 - protein, 22 aa, Artificial Sequence
  Synthetic Polypeptide
VKQTLNFDLLKLAGDVESNPGP

SEQ ID NO: 5936 - protein, 18 aa, Artificial Sequence
  Synthetic Polypeptide
EGRGSLLTCGDVEENPGP

SEQ ID NO: 5937 - protein, 19 aa, Artificial Sequence
  Synthetic Polypeptide
ATNFSLLKQAGDVEENPGP

SEQ ID NO: 5938 - protein, 19 aa, Artificial Sequence
  Synthetic Polypeptide
ATNFSLLKQAGDVEQNPGP

SEQ ID NO: 5939 - protein, 19 aa, Artificial Sequence
  Synthetic Polypeptide
ATNFSLLKQAGDVEENPGP

SEQ ID NO: 5940 - protein, 20 aa, Artificial Sequence
  Synthetic Polypeptide
QCTNYALLKLAGDVESNPGP

SEQ ID NO: 5941 - protein, 4 aa, Artificial Sequence
  Synthetic Polypeptide
SGSG

SEQ ID NO: 5942 - protein, 4 aa, Artificial Sequence
  Synthetic Polypeptide
SGSG

SEQ ID NO: 5943 - protein, 4 aa, Artificial Sequence
  Synthetic Polypeptide
RAKR

SEQ ID NO: 5944 - skipped

SEQ ID NO: 5945 - protein, 557 aa, Artificial Sequence
  Synthetic Polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRFFKVTPPPGSGPQNQYGNVLSLPTPTSGLGRAQRWAAGLGGTAPSYGNPSSDVQADGALGSRSPPGVGPEEEEGEGYEEPDSEEDSEFYENDSNLGQDQLSQDGSGYENPEDEPLGPEDEDSFSNAESYENEDEELTQPVARTMDFLSPHGSAWDPSREATSLAGSQSYEDMRGILYAAPQLRSIRGQPGPNHEEDADSYENMDNPDGPDPAWGGGGRMGTWSTR

SEQ ID NO: 5946 - protein, 365 aa, Artificial Sequence
  Synthetic Polypeptide
KEETPETPETDSEEEVTIKANLIFANGSTQTAEFKGTFEKATSEAYAYADTLKKDNGEYTVDVADKGYTLNIKFAGKEKTPEEPKEEVTIKANLIYADGKTQTAEFKGTFEEATAEAYRYADALKKDNGEYTVDVADKGYTLNIKFAGKEKTPEEPKEEVTIKANLIYADGKTQTAEFKGTFEEATAEAYRYADLLAKENGKYTVDVADKGYTLNIKFAGKEKTPEEPKEEVTIKANLIYADGKTQTAEFKGTFAEATAEAYRYADLLAKENGKYTADLEDGGYTINIRFAGKKVDEKPEEKEQVTIKENIYFEDGTVQTATFKGTFAEATAEAYRYADLLSKEHGKYTADLEDGGYTINIRFAG

SEQ ID NO: 5947 - protein, 364 aa, Artificial Sequence
  Synthetic Polypeptide
KEETPETPETDSEEEVTIKANLIFANGSTQTAEFKGTFEKATSEAYAYADTLKKDNGEYTVDVADKGYTLNIKFAGKEKTPEEPKEEVTIKANLIYADGKTQTAEFKGTFEATAEAYRYADALKKDNGEYTVDVADKGYTLNIKFAGKEKTPEEPKEEVTIKANLIYADGKTQTAEFKGTFEEATAEAYRYADLLAKENGKYTVDVADKGYTLNIKFAGKEKTPEEPKEEVTIKANLIYADGKTQTAEFKGTFAEATAEAYRYADLLAKENGKYTADLEDGGYTINIRFAGKKVDEKPEEKEQVTIKENIYFEDGTVQTATFKGTFAEATAEAYRYADLLSKEHGKYTADLEDGGYTINIRFAG

SEQ ID NO: 5948 - protein, 199 aa, Artificial Sequence
  Synthetic Polypeptide
MTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 5949 - protein, 132 aa, Artificial Sequence
  Synthetic Polypeptide
MAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 5950 - protein, 172 aa, Artificial Sequence
  Synthetic Polypeptide
MGNEASYPLEMCSHFDADEIKRLGKRFKKLDLDNSGSLSVEEFMSLPELQQNPLVQRVIDIFDTDGNGEVDFKEFIEGVSQFSVKGDKEQKLRFAFRIYDMDKDGYISNGELFQVLKMMVGNNTKLADTQLQQIVDKTIINADKDGDGRISFEEFCAVVGGLDIHKKMVVDV

SEQ ID NO: 5951 - protein, 357 aa, Artificial Sequence
  Synthetic Polypeptide
MLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 5952 - protein, 424 aa, Artificial Sequence
  Synthetic Polypeptide
MRPSGTAGAAFLALLAALCPASRALEEKKGNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEP

SEQ ID NO: 5953 - protein, 333 aa, Artificial Sequence
  Synthetic Polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRF

SEQ ID NO: 5954 - protein, 105 aa, Artificial Sequence
  Synthetic Polypeptide
MALPVTALLLPLALLLHAARPFEMLQMAGQCSQNEYFDSLLHACIPCQLRCSSNTPPLTCQRYCNASVTNSVKGTNAILWTCLGLSLIISLAVFVLMFLLRKINS

SEQ ID NO: 5955 - protein, 130 aa, Artificial Sequence
  Synthetic Polypeptide
MLLLVTSLLLCELPHPAFLLIELPTQGTFSNVSTNVSPAKPTTTAGGGSLQMAGQCSQNEYFDSLLHACIPCQLRCSSNTPPLTCQRYCNASVTNSVKGTNAILWTCLGLSLIISLAVFVLMFLLRKINS

SEQ ID NO: 5956 - protein, 157 aa, Artificial Sequence
  Synthetic Polypeptide
MALPVTALLLPLALLLHAARPCPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 5957 - protein, 288 aa, Artificial Sequence
  Synthetic Polypeptide
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 5958 - protein, 290 aa, Artificial Sequence
  Synthetic Polypeptide
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 5959 - protein, 273 aa, Artificial Sequence
  Synthetic Polypeptide
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 5960 - protein, 130 aa, Artificial Sequence
  Synthetic Polypeptide
MDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 5961 - protein, 188 aa, Artificial Sequence
  Synthetic Polypeptide
MATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 5962 - protein, 241 aa, Artificial Sequence
  Synthetic Polypeptide
MSDSKEVPSLPFLRHLLEELDSHEDSLLLFLCHDAAPGCTTVTQALCSLSQQRKLTLAALVEMLYVLQRMDLLKSRFGLSKEGAEQLLGTSFLTRYRKLMVCVGEELDSSELRALRLFACNLNPSLSTALSESSRFVELVLALENVGLVSPSSVSVLADMLRTLRRLDLCQQLVEYEQQEQARYRYCYAASPSLPVRTLRRGHGASEHEQLCMPVQESSDSPELLRTPVQESSSDSPEQTT

SEQ ID NO: 5963 - protein, 341 aa, Artificial Sequence
  Synthetic Polypeptide
MDIFREIASSMKGENVFISPPSISSVLTILYYGANGSTAEQLSKYVEKEADKNKDDISFKSMNKVYGRYSAVFKDSFLRKIGDNFQTVDFTDCRTVDAINKCVDIFTEGKINPLLDEPLSPDTCLLAISAVYFKAKWLMPFEKEFTSDYPFYVSPTEMVDVSMMSMYGEAFNHASVKESFGNFSIIELPYVGDTSMVVILPDNIDGLESIEQNLTDTNFKKWCDSMDAMFIDVHIPKFKVTGSYNLVDALVKLGLTEVFGSTGDYSNMCNSDVSVDAMIHKTYIDVNEEYTEAAAATCALVADCASTVTNEFCADHPFIYVIRHVDGKILFVGRYCSPTTN

SEQ ID NO: 5964 - protein, 299 aa, Artificial Sequence
  Synthetic Polypeptide
MCVIFPVEIDVSQTIIRDCQVDKQTRELVYINKIMNTQLTKPVLMMFNISGPIRSVTRKNNNLRDRIKSKVDEQFDQLERDYSDQMDGFHDSIKYFKDEHYSVSCQNGSVLKSKFAKILKSHDYTDKKSIEAYEKYCLPKLVDERNDYYVAVCVLKPGFENGSNQVLSFEYNPIGNKVIVPFAHEINDTGLYEYDVVAYVDSVQFDGEQFEEFVQSLILPSSFKNSEKVLYYNEASKNKSMIYKALEFTTESSWGKSEKYNWKIFCNGFIYDKKSKVLYVKLHNVTSALNKNVILNTIK

SEQ ID NO: 5965 - protein, 217 aa, Artificial Sequence
  Synthetic Polypeptide
MDPQCTMGLSNILFVMAFLLSANFSQPEIVPISNITENVYINLTCSSIHGYPEPKKMSVLLRTKNSTIEYDGIMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 5966 - protein, 141 aa, Artificial Sequence
  Synthetic Polypeptide
DIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 5967 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 5968 - protein, 140 aa, Artificial Sequence
  Synthetic Polypeptide
IQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 5969 - protein, 140 aa, Artificial Sequence; identical to SEQ ID NO: 5967
  Synthetic Polypeptide

SEQ ID NO: 5970 - protein, 140 aa, Artificial Sequence
  Synthetic Polypeptide
IQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 5971 - protein, 137 aa, Artificial Sequence
  Synthetic Polypeptide
PDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 5972 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNRAVAWSNKSDFACANAFNNSIIPEDTFFPSPESSCDVKLVEKSFETDTNLNFQNLSVIGFRILLLKVAGFNLLMTLRLWSS

SEQ ID NO: 5973 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNRAVAWSNKSDFACANAFNNSIIPEDTFFPSSDVPCDVKLVEKSFETDTNLNFQNLSVIGFRILLLKVAGFNLLMTLRLWSS

SEQ ID NO: 5974 - protein, 177 aa, Artificial Sequence
  Synthetic Polypeptide
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 5975 - protein, 179 aa, Artificial Sequence
  Synthetic Polypeptide
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 5976 - protein, 179 aa, Artificial Sequence; identical to SEQ ID NO: 5975
  Synthetic Polypeptide

SEQ ID NO: 5977 - protein, 179 aa, Artificial Sequence
  Synthetic Polypeptide
EDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 5978 - protein, 179 aa, Artificial Sequence
  Synthetic Polypeptide
EDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 5979 - protein, 179 aa, Artificial Sequence; identical to SEQ ID NO: 5975
  Synthetic Polypeptide

SEQ ID NO: 5980 - protein, 179 aa, Artificial Sequence
  Synthetic Polypeptide
EDLKNVFPPEVAVFEPSEAEISHTQKATLVCLATGFYPDHVELSWWVNGKEVHSGVSTDPQPLKEQPALNDSRYCLSSGLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 5981 - protein, 189 aa, Artificial Sequence
  Synthetic Polypeptide
DKQLDADVSPKPTIFLPSIAETKLQKAGTYLCLLEKFFPDIIKIHWQEKKSNTILGSQEGNTMKTNDTYMKFSWLTVPEESLDKEHRCIVRHENNKNGIDQEIIFPPIKTDVTTVDPKYNYSKDANDVITMDPKDNWSKDANDTLLLQLTNTSAYYMYLLLLLKSVVYFAIITCCLLGRTAFCCNGEKS

SEQ ID NO: 5982 - protein, 173 aa, Artificial Sequence
  Synthetic Polypeptide
DKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 5983 - protein, 153 aa, Artificial Sequence
  Synthetic Polypeptide
SQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 5984 - protein, 140 aa, Artificial Sequence
  Synthetic Polypeptide
IQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFLILLLKVAGFNLLMTLRLWSS

SEQ ID NO: 5985 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 5986 - protein, 140 aa, Artificial Sequence
  Synthetic Polypeptide
IQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 5987 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNRAVAWSNKSDFACANAFNNSIIPEDTFFPSPESSCDVKLVEKSFETDTNLNFQNLSVIGFLILLLKVAGFNLLMTLRLWSS

SEQ ID NO: 5988 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNRAVAWSNKSDFACANAFNNSIIPEDTFFPSSDVPCDVKLVEKSFETDTNLNFQNLSVIGFLILLLKVAGFNLLMTLRLWSS

SEQ ID NO: 5989 - protein, 163 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFLILLLKVAGFNLLMTLRLWSS

SEQ ID NO: 5990 - protein, 163 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFLILLLKVAGFNLLMTLRLWSS

SEQ ID NO: 5991 - protein, 140 aa, Artificial Sequence
  Synthetic Polypeptide
IQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVALFALLMTLRLWSS

SEQ ID NO: 5992 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 5993 - protein, 140 aa, Artificial Sequence
  Synthetic Polypeptide
IQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 5994 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNRAVAWSNKSDFACANAFNNSIIPEDTFFPSPESSCDVKLVEKSFETDTNLNFQNLSVIGFRILLLKVALFALLMTLRLWSS

SEQ ID NO: 5995 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNRAVAWSNKSDFACANAFNNSIIPEDTFFPSSDVPCDVKLVEKSFETDTNLNFQNLSVIGFRILLLKVALFALLMTLRLWSS

SEQ ID NO: 5996 - protein, 163 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVALFALLMTLRLWSS

SEQ ID NO: 5997 - protein, 163 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVALFALLMTLRLWSS

SEQ ID NO: 5998 - protein, 72 aa, Artificial Sequence
  Synthetic Polypeptide
AKPTTTPAPRPPTPAPTIASQPLSLRPEACRPAAGGAVHTRGLDFACDIYIWAPLAGTCGVLLLSLVITLYC

SEQ ID NO: 5999 - protein, 226 aa, Artificial Sequence
  Synthetic Polypeptide
AKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6000 - protein, 114 aa, Artificial Sequence
  Synthetic Polypeptide
AKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCEL

SEQ ID NO: 6001 - protein, 42 aa, Artificial Sequence
  Synthetic Polypeptide
KRGRKKLLYIFKQPFMRPVQTTQEEDGCSCRFPEEEEGGCEL

SEQ ID NO: 6002 - protein, 112 aa, Artificial Sequence
  Synthetic Polypeptide
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6003 - protein, 112 aa, Artificial Sequence; identical to SEQ ID NO: 6002
  Synthetic Polypeptide

SEQ ID NO: 6004 - protein, 108 aa, Artificial Sequence
  Synthetic Polypeptide
KIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 6005 - protein, 150 aa, Artificial Sequence
  Synthetic Polypeptide
FKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 6006 - protein, 185 aa, Artificial Sequence
  Synthetic Polypeptide
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVQNPDYEPIRKGQRDLYSGLNQRRI

SEQ ID NO: 6007 - protein, 160 aa, Artificial Sequence
  Synthetic Polypeptide
QSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 6008 - protein, 143 aa, Artificial Sequence
  Synthetic Polypeptide
QSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 6009 - protein, 173 aa, Artificial Sequence
  Synthetic Polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKS

SEQ ID NO: 6010 - protein, 159 aa, Artificial Sequence
  Synthetic Polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRG

SEQ ID NO: 6011 - protein, 159 aa, Artificial Sequence
  Synthetic Polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRG

SEQ ID NO: 6012 - protein, 171 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFL

SEQ ID NO: 6013 - protein, 163 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSS

SEQ ID NO: 6014 - protein, 163 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 6015 - protein, 234 aa, Artificial Sequence
  Synthetic Polypeptide
PAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKK

SEQ ID NO: 6016 - protein, 235 aa, Artificial Sequence
  Synthetic Polypeptide
PAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSSLSPGKK

SEQ ID NO: 6017 - protein, 229 aa, Artificial Sequence
  Synthetic Polypeptide
ESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 6018 - protein, 119 aa, Artificial Sequence
  Synthetic Polypeptide
ESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 6019 - protein, 12 aa, Artificial Sequence
  Synthetic Polypeptide
ESKYGPPCPPCP

SEQ ID NO: 6020 - skipped

SEQ ID NO: 6021 - protein, 269 aa, Artificial Sequence
  Synthetic Polypeptide
EPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGW

SEQ ID NO: 6022 - protein, 490 aa, Artificial Sequence
  Synthetic Polypeptide
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETA

SEQ ID NO: 6023 - protein, 167 aa, Artificial Sequence
  Synthetic Polypeptide
MALPVTALLLPLALLLHAARPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQ

SEQ ID NO: 6024 - protein, 146 aa, Artificial Sequence
  Synthetic Polypeptide
GWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQ

SEQ ID NO: 6025 - protein, 167 aa, Artificial Sequence
  Synthetic Polypeptide
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQ

SEQ ID NO: 6026 - protein, 162 aa, Artificial Sequence
  Synthetic Polypeptide
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDF

SEQ ID NO: 6027 - protein, 241 aa, Artificial Sequence
  Synthetic Polypeptide
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATG

SEQ ID NO: 6028 - protein, 300 aa, Artificial Sequence
  Synthetic Polypeptide
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGAN

SEQ ID NO: 6029 - protein, 709 aa, Artificial Sequence
  Synthetic Polypeptide
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPA

SEQ ID NO: 6030 - protein, 239 aa, Artificial Sequence
  Synthetic Polypeptide
MSAPRLLISIIIMVSASSSSCMGGKQMTQNYSTIFAEGNISQPVLMDINAVLCCPPIALRNLIIITWEIILRGQPSCTKAYKKETNETKETNCTVERITWVSRPDQNSDLQILPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLL

SEQ ID NO: 6031 - protein, 488 aa, Artificial Sequence
  Synthetic Polypeptide
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSA

SEQ ID NO: 6032 - protein, 664 aa, Artificial Sequence
  Synthetic Polypeptide
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLDGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQT

SEQ ID NO: 6033 - protein, 252 aa, Artificial Sequence
  Synthetic Polypeptide
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQE

SEQ ID NO: 6034 - protein, 290 aa, Artificial Sequence
  Synthetic Polypeptide
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKT

SEQ ID NO: 6035 - protein, 268 aa, Artificial Sequence
  Synthetic Polypeptide
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKQAR

SEQ ID NO: 6036 - protein, 265 aa, Artificial Sequence
  Synthetic Polypeptide
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKQRMICEKMANPVQLGSTYFREA

SEQ ID NO: 6037 - protein, 163 aa, Artificial Sequence
  Synthetic Polypeptide
MALPVTALLLPLALLLHAARPFECPAGIYAPICSGGGGSCGGGGSKISHFLKMESLNFIRAHTPYINIYNCEPANPSEKNSPSTQYCYSIQSGGGGSCGGGGSPAGIYAPIGGGGSKISHFLKMESLNFIRAHTPYINIYNCEPANPSEKNSPSTQYCYSIQS

SEQ ID NO: 6038 - protein, 105 aa, Artificial Sequence
  Synthetic Polypeptide
MALPVTALLLPLALLLHAARPFECPAGIYAPICSGGGGSCGGGGSKISHFLKMESLNFIRAHTPYINIYNCEPANPSEKNSPSTQYCYSIQSGGGGSCGGGGSTR

SEQ ID NO: 6039 - protein, 515 aa, Artificial Sequence
  Synthetic Polypeptide
MSLWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRR

SEQ ID NO: 6040 - protein, 413 aa, Artificial Sequence
  Synthetic Polypeptide
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMG

SEQ ID NO: 6041 - protein, 361 aa, Artificial Sequence
  Synthetic Polypeptide
MRPSGTAGAALLALLAALCPASRALEEKKGNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGC

SEQ ID NO: 6042 - protein, 54 aa, Artificial Sequence
  Synthetic Polypeptide
MLQMAGQCSQNEYFDSLLHACIPCQLRCSSNTPPLTCQRYCNASVTNSVKGTNA

SEQ ID NO: 6043 - protein, 226 aa, Artificial Sequence
  Synthetic Polypeptide
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSM

SEQ ID NO: 6044 - protein, 135 aa, Artificial Sequence
  Synthetic Polypeptide
LFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 6045 - skipped

SEQ ID NO: 6046 - protein, 675 aa, Artificial Sequence
  Synthetic Polypeptide
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETATRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASWKDASGWS

SEQ ID NO: 6047 - protein, 483 aa, Artificial Sequence
  Synthetic Polypeptide
MPPPRLLFFLLFLTPMEVRPDYKDDDDKEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILASWKDASGWS

SEQ ID NO: 6048 - protein, 765 aa, Artificial Sequence
  Synthetic Polypeptide
MPPPRLLFFLLFLTPMEVRPDYKDDDDKEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6049 - protein, 739 aa, Artificial Sequence
  Synthetic Polypeptide
MPPPRLLFFLLFLTPMEVRPDYKDDDDKEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWGGSEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6050 - protein, 719 aa, Artificial Sequence
  Synthetic Polypeptide
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6051 - protein, 695 aa, Artificial Sequence
  Synthetic Polypeptide
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRGGSEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6052 - protein, 708 aa, Artificial Sequence
  Synthetic Polypeptide
MRRAALWLWLCALALSLQPALPQIVATNLPPEDQDGSGDDSDNFSGSGAGALQDITLSQQTPSTWKDTQLLTAIPTSPEPTGLEATAASTSTLPAGEGPKEGEAVVLPEVEPGLTAREQEATPRPRETTQLPTTHQASTTTATTAQEPATSHPHRDMQPGHHETSTPAGPSQADLHTPHTEDGGPSATERAAEDGASSQLPAAEGSGEQDFTFETSGENTAVVAVEPDRRNQSPVDQGATGTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6053 - protein, 767 aa, Artificial Sequence
  Synthetic Polypeptide
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6054 - protein, 1176 aa, Artificial Sequence
  Synthetic Polypeptide
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPATRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6055 - protein, 706 aa, Artificial Sequence
  Synthetic Polypeptide
MSAPRLLISIIIMVSASSSSCMGGKQMTQNYSTIFAEGNISQPVLMDINAVLCCPPIALRNLIIITWEIILRGQPSCTKAYKKETNETKETNCTVERITWVSRPDQNSDLQILPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6056 - protein, 955 aa, Artificial Sequence
  Synthetic Polypeptide
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSATRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6057 - protein, 1131 aa, Artificial Sequence
  Synthetic Polypeptide
MGAARGSPARPRRLPLLSVLLLPLLGGTQTAIVFIKQPSSQDALQGRRALLRCEVEAPGPVHVYWLLDGAPVQDTERRFAQGSSLSFAAVDRLQDSGTFQCVARDDVTGEEARSANASFNIKWIEAGPVVLKHPASEAEIQPQTQVTLRCHIDGHPRPTYQWFRDGTPLSDGQSNHTVSSKERNLTLRPAGPEHSGLYSCCAHSAFGQACSSQNFTLSIADESFARVVLAPQDVVVARYEEAMFHCQFSAQPPPSLQWLFEDETPITNRSRPPHLRRATVFANGSLLLTQVRPRNAGIYRCIGQGQRGPPIILEATLHLAEIEDMPLFEPRVFTAGSEERVTCLPPKGLPEPSVWWEHAGVRLPTHGRVYQKGHELVLANIAESDAGVYTCHAANLAGQRRQDVNITVATVPSWLKKPQDSQLEEGKPGYLDCLTQATPKPTVVWYRNQMLISEDSRFEVFKNGTLRINSVEVYDGTWYRCMSSTPAGSIEAQARVQVLDGSSLPEWVTDNAGTLHFARVTRDDAGNYTCIASNGPQGQIRAHVQLTVAVFITFKVEPERTTVYQGHTALLQCEAQGDPKPLIQWKGKDRILDPTKLGPRMHIFQNGSLVIHDVAPEDSGRYTCIAGNSCNIKHTEAPLYVVDKPVPEESEGPGSPPPYKMIQTTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6058 - protein, 757 aa, Artificial Sequence
  Synthetic Polypeptide
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6059 - protein, 735 aa, Artificial Sequence
  Synthetic Polypeptide
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSTCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKQARTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6060 - protein, 732 aa, Artificial Sequence
  Synthetic Polypeptide
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKQRMICEKMANPVQLGSTYFREATRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6061 - protein, 630 aa, Artificial Sequence
  Synthetic Polypeptide
MALPVTALLLPLALLLHAARPFECPAGIYAPICSGGGGSCGGGGSKISHFLKMESLNFIRAHTPYINIYNCEPANPSEKNSPSTQYCYSIQSGGGGSCGGGGSPAGIYAPIGGGGSKISHFLKMESLNFIRAHTPYINIYNCEPANPSEKNSPSTQYCYSIQSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6062 - protein, 572 aa, Artificial Sequence
  Synthetic Polypeptide
MALPVTALLLPLALLLHAARPFECPAGIYAPICSGGGGSCGGGGSKISHFLKMESLNFIRAHTPYINIYNCEPANPSEKNSPSTQYCYSIQSGGGGSCGGGGSTRTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6063 - protein, 982 aa, Artificial Sequence
  Synthetic Polypeptide
MSLWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6064 - protein, 880 aa, Artificial Sequence
  Synthetic Polypeptide
MRPADLLQLVLLLDLPRDLGGMGCSSPPCECHQEEDFRVTCKDIQRIPSLPPSTQTLKLIETHLRTIPSHAFSNLPNISRIYVSIDVTLQQLESHSFYNLSKVTHIEIRNTRNLTYIDPDALKELPLLKFLGIFNTGLKMFPDLTKVYSTDIFFILEITDNPYMTSIPVNAFQGLCNETLTLKLYNNGFTSVQGYAFNGTKLDAVYLNKNKYLTVIDKDAFGGVYSGPSLLDVSQTSVTALPSKGLEHLKELIARNTWTLKKLPLSLSFLHLTRADLSYPSHCCAFKNQKKIRGILESLMCNESSMQSLRQRKSVNALNSPLHQEYEENLGDSIVGYKEKSKFQDTHNNAHYYVFFEEQEDEIIGFGQELKNPQEETLQAFDSHYDYTICGDSEDMVCTPKSDEFNPCEDIMGTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6065 - protein, 828 aa, Artificial Sequence
  Synthetic Polypeptide
MRPSGTAGAALLALLAALCPASRALEEKKGNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6066 - protein, 544 aa, Artificial Sequence
  Synthetic Polypeptide
MALPVTALLLPLALLLHAARPFEMLQMAGQCSQNEYFDSLLHACIPCQLRCSSNTPPLTCQRYCNASVTNSVKGTNATRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6067 - protein, 693 aa, Artificial Sequence
  Synthetic Polypeptide
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6068 - protein, 634 aa, Artificial Sequence
  Synthetic Polypeptide
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6069 - protein, 629 aa, Artificial Sequence
  Synthetic Polypeptide
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6070 - protein, 623 aa, Artificial Sequence
  Synthetic Polypeptide
MALPVTALLLPLALLLHAARPLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTVTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6071 - protein, 855 aa, Artificial Sequence
  Synthetic Polypeptide
MALPVTALLLPLALLLHAARPEFKEETPETPETDSEEEVTIKANLIFANGSTQTAEFKGTFEKATSEAYAYADTLKKDNGEYTVDVADKGYTLNIKFAGKEKTPEEPKEEVTIKANLIYADGKTQTAEFKGTFEEATAEAYRYADALKKDNGEYTVDVADKGYTLNIKFAGKEKTPEEPKEEVTIKANLIYADGKTQTAEFKGTFEEATAEAYRYADLLAKENGKYTVDVADKGYTLNIKFAGKEKTPEEPKEEVTIKANLIYADGKTQTAEFKGTFAEATAEAYRYADLLAKENGKYTADLEDGGYTINIRFAGKKVDEKPEEKEQVTIKENIYFEDGTVQTATFKGTFAEATAEAYRYADLLSKEHGKYTADLEDGGYTINIRFAGTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6072 - protein, 854 aa, Artificial Sequence
  Synthetic Polypeptide
MALPVTALLLPLALLLHAARPEFKEETPETPETDSEEEVTIKANLIFANGSTQTAEFKGTFEKATSEAYAYADTLKKDNGEYTVDVADKGYTLNIKFAGKEKTPEEPKEEVTIKANLIYADGKTQTAEFKGTFEATAEAYRYADALKKDNGEYTVDVADKGYTLNIKFAGKEKTPEEPKEEVTIKANLIYADGKTQTAEFKGTFEEATAEAYRYADLLAKENGKYTVDVADKGYTLNIKFAGKEKTPEEPKEEVTIKANLIYADGKTQTAEFKGTFAEATAEAYRYADLLAKENGKYTADLEDGGYTINIRFAGKKVDEKPEEKEQVTIKENIYFEDGTVQTATFKGTFAEATAEAYRYADLLSKEHGKYTADLEDGGYTINIRFAGTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6073 - skipped

SEQ ID NO: 6074 - protein, 730 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6075 - protein, 731 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6076 - protein, 732 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6077 - protein, 732 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6078 - protein, 732 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6079 - protein, 733 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6080 - protein, 735 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6081 - protein, 736 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6082 - protein, 739 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6083 - protein, 735 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6084 - protein, 732 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6085 - protein, 736 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6086 - protein, 729 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6087 - protein, 730 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6088 - protein, 729 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6089 - protein, 728 aa, Artificial Sequence
  Synthetic Polypeptide
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 6090 - protein, 240 aa, Artificial Sequence
  Synthetic Polypeptide
MDIVLTQSPASLAVSLGQRATISCRASESVDDYGISFMNWFQQKPGQPPKLLIYAAPNQGSGVPARFSGSGSGTDFSLNIHPMEEDDTAMYFCQQSKDVRWRHQAGDQTGGGGSGGGGSGGGGSEVKLVESGGGLVQPGGSLKLSCAASGFDFSRYWMSWVRQAPGKGLEWIGEINLDSSTINYTPSLKDKFIISRDNAKNTLYLQMSKVRSEDTALYYCARRYDAMDYWGQGTSVTVSS

SEQ ID NO: 6091 - protein, 244 aa, Artificial Sequence
  Synthetic Polypeptide
MDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSR

SEQ ID NO: 6092 - protein, 245 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTR

SEQ ID NO: 6093 - protein, 245 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTR

SEQ ID NO: 6094 - protein, 246 aa, Artificial Sequence
  Synthetic Polypeptide
MDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTR

SEQ ID NO: 6095 - protein, 253 aa, Artificial Sequence
  Synthetic Polypeptide
MDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTR

SEQ ID NO: 6096 - protein, 270 aa, Artificial Sequence
  Synthetic Polypeptide
MINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTR

SEQ ID NO: 6097 - protein, 247 aa, Artificial Sequence
  Synthetic Polypeptide
MDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTR

SEQ ID NO: 6098 - protein, 246 aa, Artificial Sequence
  Synthetic Polypeptide
MQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTR

SEQ ID NO: 6099 - protein, 252 aa, Artificial Sequence
  Synthetic Polypeptide
MQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTR

SEQ ID NO: 6100 - protein, 257 aa, Artificial Sequence
  Synthetic Polypeptide
MQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTR

SEQ ID NO: 6101 - protein, 244 aa, Artificial Sequence
  Synthetic Polypeptide
MDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATR

SEQ ID NO: 6102 - protein, 254 aa, Artificial Sequence
  Synthetic Polypeptide
MDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTR

SEQ ID NO: 6103 - protein, 245 aa, Artificial Sequence
  Synthetic Polypeptide
MDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTR

SEQ ID NO: 6104 - protein, 249 aa, Artificial Sequence
  Synthetic Polypeptide
MDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTR

SEQ ID NO: 6105 - protein, 247 aa, Artificial Sequence
  Synthetic Polypeptide
MDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTR

SEQ ID NO: 6106 - protein, 247 aa, Artificial Sequence
  Synthetic Polypeptide
MDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTR

SEQ ID NO: 6107 - protein, 248 aa, Artificial Sequence
  Synthetic Polypeptide
MQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTR

SEQ ID NO: 6108 - protein, 246 aa, Artificial Sequence
  Synthetic Polypeptide
MQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTR

SEQ ID NO: 6109 - protein, 257 aa, Artificial Sequence
  Synthetic Polypeptide
MLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTR

SEQ ID NO: 6110 - protein, 246 aa, Artificial Sequence
  Synthetic Polypeptide
MDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTR

SEQ ID NO: 6111 - protein, 247 aa, Artificial Sequence
  Synthetic Polypeptide
MDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTR

SEQ ID NO: 6112 - protein, 248 aa, Artificial Sequence
  Synthetic Polypeptide
MDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTR

SEQ ID NO: 6113 - protein, 248 aa, Artificial Sequence
  Synthetic Polypeptide
MDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTR

SEQ ID NO: 6114 - protein, 248 aa, Artificial Sequence; identical to SEQ ID NO: 6113
  Synthetic Polypeptide

SEQ ID NO: 6115 - protein, 248 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTR

SEQ ID NO: 6116 - protein, 250 aa, Artificial Sequence
  Synthetic Polypeptide
MDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTR

SEQ ID NO: 6117 - protein, 247 aa, Artificial Sequence
  Synthetic Polypeptide
MDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTR

SEQ ID NO: 6118 - protein, 250 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTR

SEQ ID NO: 6119 - protein, 248 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTR

SEQ ID NO: 6120 - protein, 247 aa, Artificial Sequence
  Synthetic Polypeptide
MDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTR

SEQ ID NO: 6121 - protein, 257 aa, Artificial Sequence
  Synthetic Polypeptide
MSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTR

SEQ ID NO: 6122 - protein, 249 aa, Artificial Sequence
  Synthetic Polypeptide
MQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTR

SEQ ID NO: 6123 - protein, 247 aa, Artificial Sequence; identical to SEQ ID NO: 6120
  Synthetic Polypeptide

SEQ ID NO: 6124 - protein, 246 aa, Artificial Sequence
  Synthetic Polypeptide
MEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTR

SEQ ID NO: 6125 - protein, 248 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTR

SEQ ID NO: 6126 - protein, 246 aa, Artificial Sequence
  Synthetic Polypeptide
MEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTR

SEQ ID NO: 6127 - protein, 251 aa, Artificial Sequence
  Synthetic Polypeptide
MDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTR

SEQ ID NO: 6128 - protein, 243 aa, Artificial Sequence
  Synthetic Polypeptide
MDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTR

SEQ ID NO: 6129 - protein, 249 aa, Artificial Sequence
  Synthetic Polypeptide
MDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTR

SEQ ID NO: 6130 - protein, 249 aa, Artificial Sequence
  Synthetic Polypeptide
MQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTR

SEQ ID NO: 6131 - protein, 242 aa, Artificial Sequence
  Synthetic Polypeptide
MDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTR

SEQ ID NO: 6132 - protein, 247 aa, Artificial Sequence
  Synthetic Polypeptide
MDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTR

SEQ ID NO: 6133 - protein, 244 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTR

SEQ ID NO: 6134 - protein, 254 aa, Artificial Sequence
  Synthetic Polypeptide
MDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTR

SEQ ID NO: 6135 - protein, 250 aa, Artificial Sequence
  Synthetic Polypeptide
MDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTR

SEQ ID NO: 6136 - protein, 276 aa, Artificial Sequence
  Synthetic Polypeptide
MYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTR

SEQ ID NO: 6137 - protein, 275 aa, Artificial Sequence
  Synthetic Polypeptide
MYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTR

SEQ ID NO: 6138 - protein, 291 aa, Artificial Sequence
  Synthetic Polypeptide
MDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITR

SEQ ID NO: 6139 - protein, 247 aa, Artificial Sequence
  Synthetic Polypeptide
MEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTR

SEQ ID NO: 6140 - protein, 246 aa, Artificial Sequence
  Synthetic Polypeptide
MDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTR

SEQ ID NO: 6141 - protein, 243 aa, Artificial Sequence
  Synthetic Polypeptide
MDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTR

SEQ ID NO: 6142 - protein, 253 aa, Artificial Sequence
  Synthetic Polypeptide
MDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTR

SEQ ID NO: 6143 - protein, 240 aa, Artificial Sequence
  Synthetic Polypeptide
MDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTR

SEQ ID NO: 6144 - protein, 248 aa, Artificial Sequence
  Synthetic Polypeptide
MDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTR

SEQ ID NO: 6145 - protein, 244 aa, Artificial Sequence
  Synthetic Polypeptide
MDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTR

SEQ ID NO: 6146 - protein, 248 aa, Artificial Sequence
  Synthetic Polypeptide
MDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTR

SEQ ID NO: 6147 - protein, 244 aa, Artificial Sequence
  Synthetic Polypeptide
MDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTR

SEQ ID NO: 6148 - protein, 252 aa, Artificial Sequence
  Synthetic Polypeptide
MDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTR

SEQ ID NO: 6149 - protein, 247 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTR

SEQ ID NO: 6150 - protein, 251 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTR

SEQ ID NO: 6151 - protein, 251 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTR

SEQ ID NO: 6152 - protein, 245 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTR

SEQ ID NO: 6153 - protein, 247 aa, Artificial Sequence
  Synthetic Polypeptide
MQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTR

SEQ ID NO: 6154 - protein, 244 aa, Artificial Sequence
  Synthetic Polypeptide
MDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTR

SEQ ID NO: 6155 - protein, 245 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTR

SEQ ID NO: 6156 - protein, 241 aa, Artificial Sequence
  Synthetic Polypeptide
MDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTR

SEQ ID NO: 6157 - protein, 272 aa, Artificial Sequence
  Synthetic Polypeptide
MYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTR

SEQ ID NO: 6158 - protein, 243 aa, Artificial Sequence
  Synthetic Polypeptide
MEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTR

SEQ ID NO: 6159 - protein, 252 aa, Artificial Sequence
  Synthetic Polypeptide
MDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTR

SEQ ID NO: 6160 - protein, 256 aa, Artificial Sequence
  Synthetic Polypeptide
MDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTR

SEQ ID NO: 6161 - protein, 247 aa, Artificial Sequence
  Synthetic Polypeptide
MDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTR

SEQ ID NO: 6162 - protein, 242 aa, Artificial Sequence
  Synthetic Polypeptide
MDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTR

SEQ ID NO: 6163 - protein, 245 aa, Artificial Sequence
  Synthetic Polypeptide
MEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTR

SEQ ID NO: 6164 - protein, 240 aa, Artificial Sequence
  Synthetic Polypeptide
MQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATR

SEQ ID NO: 6165 - protein, 250 aa, Artificial Sequence
  Synthetic Polypeptide
MDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTR

SEQ ID NO: 6166 - protein, 242 aa, Artificial Sequence
  Synthetic Polypeptide
MDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTR

SEQ ID NO: 6167 - protein, 245 aa, Artificial Sequence
  Synthetic Polypeptide
MDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTR

SEQ ID NO: 6168 - protein, 255 aa, Artificial Sequence
  Synthetic Polypeptide
MDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTR

SEQ ID NO: 6169 - protein, 252 aa, Artificial Sequence
  Synthetic Polypeptide
MEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTR

SEQ ID NO: 6170 - protein, 244 aa, Artificial Sequence
  Synthetic Polypeptide
MDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATR

SEQ ID NO: 6171 - protein, 237 aa, Artificial Sequence
  Synthetic Polypeptide
MMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTR

SEQ ID NO: 6172 - protein, 242 aa, Artificial Sequence
  Synthetic Polypeptide
MQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTR

SEQ ID NO: 6173 - protein, 245 aa, Artificial Sequence
  Synthetic Polypeptide
MDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTR

SEQ ID NO: 6174 - protein, 250 aa, Artificial Sequence
  Synthetic Polypeptide
MDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTR

SEQ ID NO: 6175 - protein, 245 aa, Artificial Sequence
  Synthetic Polypeptide
MDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTR

SEQ ID NO: 6176 - protein, 251 aa, Artificial Sequence
  Synthetic Polypeptide
MDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTR

SEQ ID NO: 6177 - protein, 249 aa, Artificial Sequence
  Synthetic Polypeptide
MEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTR

SEQ ID NO: 6178 - protein, 249 aa, Artificial Sequence
  Synthetic Polypeptide
MEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTR

SEQ ID NO: 6179 - protein, 247 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTR

SEQ ID NO: 6180 - protein, 244 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTR

SEQ ID NO: 6181 - protein, 245 aa, Artificial Sequence
  Synthetic Polypeptide
MDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTR

SEQ ID NO: 6182 - protein, 247 aa, Artificial Sequence
  Synthetic Polypeptide
MDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTR

SEQ ID NO: 6183 - protein, 248 aa, Artificial Sequence
  Synthetic Polypeptide
MDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTR

SEQ ID NO: 6184 - protein, 248 aa, Artificial Sequence
  Synthetic Polypeptide
MDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTR

SEQ ID NO: 6185 - protein, 248 aa, Artificial Sequence
  Synthetic Polypeptide
MDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTR

SEQ ID NO: 6186 - protein, 246 aa, Artificial Sequence
  Synthetic Polypeptide
MDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATR

SEQ ID NO: 6187 - protein, 246 aa, Artificial Sequence
  Synthetic Polypeptide
MDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTR

SEQ ID NO: 6188 - protein, 251 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTR

SEQ ID NO: 6189 - protein, 251 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTR

SEQ ID NO: 6190 - protein, 249 aa, Artificial Sequence
  Synthetic Polypeptide
MDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTR

SEQ ID NO: 6191 - protein, 244 aa, Artificial Sequence
  Synthetic Polypeptide
MEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTR

SEQ ID NO: 6192 - protein, 239 aa, Artificial Sequence
  Synthetic Polypeptide
MDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTR

SEQ ID NO: 6193 - protein, 245 aa, Artificial Sequence
  Synthetic Polypeptide
MDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTR

SEQ ID NO: 6194 - protein, 252 aa, Artificial Sequence
  Synthetic Polypeptide
MDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTR

SEQ ID NO: 6195 - protein, 253 aa, Artificial Sequence
  Synthetic Polypeptide
MDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTR

SEQ ID NO: 6196 - protein, 250 aa, Artificial Sequence
  Synthetic Polypeptide
MDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTR

SEQ ID NO: 6197 - protein, 247 aa, Artificial Sequence
  Synthetic Polypeptide
MDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTR

SEQ ID NO: 6198 - protein, 258 aa, Artificial Sequence
  Synthetic Polypeptide
MDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTR

SEQ ID NO: 6199 - protein, 254 aa, Artificial Sequence
  Synthetic Polypeptide
MQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTR

SEQ ID NO: 6200 - protein, 248 aa, Artificial Sequence
  Synthetic Polypeptide
MDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTR

SEQ ID NO: 6201 - protein, 245 aa, Artificial Sequence
  Synthetic Polypeptide
MDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTR

SEQ ID NO: 6202 - protein, 243 aa, Artificial Sequence
  Synthetic Polypeptide
MDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTR

SEQ ID NO: 6203 - protein, 245 aa, Artificial Sequence
  Synthetic Polypeptide
MDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTR

SEQ ID NO: 6204 - protein, 247 aa, Artificial Sequence
  Synthetic Polypeptide
MQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTR

SEQ ID NO: 6205 - protein, 252 aa, Artificial Sequence
  Synthetic Polypeptide
MQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTR

SEQ ID NO: 6206 - protein, 246 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTR

SEQ ID NO: 6207 - protein, 247 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTR

SEQ ID NO: 6208 - protein, 246 aa, Artificial Sequence
  Synthetic Polypeptide
MQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTR

SEQ ID NO: 6209 - protein, 245 aa, Artificial Sequence
  Synthetic Polypeptide
MQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTR

SEQ ID NO: 6210 - protein, 245 aa, Artificial Sequence
  Synthetic Polypeptide
MQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTR

SEQ ID NO: 6211 - protein, 247 aa, Artificial Sequence
  Synthetic Polypeptide
MQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTR

SEQ ID NO: 6212 - protein, 245 aa, Artificial Sequence
  Synthetic Polypeptide
MDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATR

SEQ ID NO: 6213 - protein, 244 aa, Artificial Sequence
  Synthetic Polypeptide
MDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTR

SEQ ID NO: 6214 - protein, 244 aa, Artificial Sequence
  Synthetic Polypeptide
MDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTR

SEQ ID NO: 6215 - protein, 252 aa, Artificial Sequence
  Synthetic Polypeptide
MDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTR

SEQ ID NO: 6216 - protein, 258 aa, Artificial Sequence
  Synthetic Polypeptide
MQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTR

SEQ ID NO: 6217 - protein, 243 aa, Artificial Sequence
  Synthetic Polypeptide
MEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTR

SEQ ID NO: 6218 - protein, 253 aa, Artificial Sequence
  Synthetic Polypeptide
MELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTR

SEQ ID NO: 6219 - protein, 249 aa, Artificial Sequence
  Synthetic Polypeptide
MDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTR

SEQ ID NO: 6220 - protein, 233 aa, Artificial Sequence
  Synthetic Polypeptide
MDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTR

SEQ ID NO: 6221 - protein, 243 aa, Artificial Sequence
  Synthetic Polypeptide
MDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTR

SEQ ID NO: 6222 - protein, 247 aa, Artificial Sequence
  Synthetic Polypeptide
MDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTR

SEQ ID NO: 6223 - protein, 243 aa, Artificial Sequence
  Synthetic Polypeptide
MDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTR

SEQ ID NO: 6224 - protein, 244 aa, Artificial Sequence
  Synthetic Polypeptide
MDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTR

SEQ ID NO: 6225 - protein, 249 aa, Artificial Sequence
  Synthetic Polypeptide
MDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTR

SEQ ID NO: 6226 - protein, 243 aa, Artificial Sequence
  Synthetic Polypeptide
MDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTR

SEQ ID NO: 6227 - protein, 244 aa, Artificial Sequence
  Synthetic Polypeptide
MDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATR

SEQ ID NO: 6228 - protein, 252 aa, Artificial Sequence
  Synthetic Polypeptide
MDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTR

SEQ ID NO: 6229 - protein, 248 aa, Artificial Sequence; identical to SEQ ID NO: 6146
  Synthetic Polypeptide

SEQ ID NO: 6230 - protein, 245 aa, Artificial Sequence
  Synthetic Polypeptide
MDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTR

SEQ ID NO: 6231 - protein, 245 aa, Artificial Sequence
  Synthetic Polypeptide
MDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTR

SEQ ID NO: 6232 - protein, 244 aa, Artificial Sequence
  Synthetic Polypeptide
MDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTR

SEQ ID NO: 6233 - protein, 243 aa, Artificial Sequence
  Synthetic Polypeptide
MDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTR

SEQ ID NO: 6234 - protein, 244 aa, Artificial Sequence
  Synthetic Polypeptide
MDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTR

SEQ ID NO: 6235 - protein, 248 aa, Artificial Sequence
  Synthetic Polypeptide
MDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTR

SEQ ID NO: 6236 - protein, 251 aa, Artificial Sequence
  Synthetic Polypeptide
MDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTR

SEQ ID NO: 6237 - protein, 253 aa, Artificial Sequence
  Synthetic Polypeptide
MDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTR

SEQ ID NO: 6238 - protein, 252 aa, Artificial Sequence
  Synthetic Polypeptide
MDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTR

SEQ ID NO: 6239 - protein, 242 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTR

SEQ ID NO: 6240 - protein, 244 aa, Artificial Sequence
  Synthetic Polypeptide
MDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTR

SEQ ID NO: 6241 - protein, 244 aa, Artificial Sequence
  Synthetic Polypeptide
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTR

SEQ ID NO: 6242 - protein, 245 aa, Artificial Sequence
  Synthetic Polypeptide
MAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTR

SEQ ID NO: 6243 - protein, 243 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTR

SEQ ID NO: 6244 - protein, 262 aa, Artificial Sequence
  Synthetic Polypeptide
MDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTR

SEQ ID NO: 6245 - protein, 259 aa, Artificial Sequence
  Synthetic Polypeptide
MDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTR

SEQ ID NO: 6246 - protein, 233 aa, Artificial Sequence
  Synthetic Polypeptide
MDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTR

SEQ ID NO: 6247 - protein, 249 aa, Artificial Sequence
  Synthetic Polypeptide
MDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTR

SEQ ID NO: 6248 - protein, 240 aa, Artificial Sequence
  Synthetic Polypeptide
MDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTR

SEQ ID NO: 6249 - protein, 241 aa, Artificial Sequence
  Synthetic Polypeptide
MDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTR

SEQ ID NO: 6250 - protein, 241 aa, Artificial Sequence
  Synthetic Polypeptide
MDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATR

SEQ ID NO: 6251 - protein, 252 aa, Artificial Sequence
  Synthetic Polypeptide
MEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTR

SEQ ID NO: 6252 - protein, 248 aa, Artificial Sequence
  Synthetic Polypeptide
MQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTR

SEQ ID NO: 6253 - protein, 243 aa, Artificial Sequence
  Synthetic Polypeptide
MENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTR

SEQ ID NO: 6254 - protein, 247 aa, Artificial Sequence
  Synthetic Polypeptide
MDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTR

SEQ ID NO: 6255 - protein, 256 aa, Artificial Sequence
  Synthetic Polypeptide
MDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTR

SEQ ID NO: 6256 - protein, 247 aa, Artificial Sequence
  Synthetic Polypeptide
MDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTR

SEQ ID NO: 6257 - protein, 250 aa, Artificial Sequence
  Synthetic Polypeptide
MDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTR

SEQ ID NO: 6258 - protein, 245 aa, Artificial Sequence
  Synthetic Polypeptide
MDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATR

SEQ ID NO: 6259 - protein, 246 aa, Artificial Sequence
  Synthetic Polypeptide
MEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTR

SEQ ID NO: 6260 - protein, 243 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTR

SEQ ID NO: 6261 - protein, 255 aa, Artificial Sequence
  Synthetic Polypeptide
MDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTR

SEQ ID NO: 6262 - protein, 245 aa, Artificial Sequence
  Synthetic Polypeptide
MEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTR

SEQ ID NO: 6263 - protein, 242 aa, Artificial Sequence
  Synthetic Polypeptide
MDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTR

SEQ ID NO: 6264 - protein, 247 aa, Artificial Sequence
  Synthetic Polypeptide
MDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTR

SEQ ID NO: 6265 - protein, 246 aa, Artificial Sequence
  Synthetic Polypeptide
MDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTR

SEQ ID NO: 6266 - protein, 248 aa, Artificial Sequence
  Synthetic Polypeptide
MDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTR

SEQ ID NO: 6267 - protein, 244 aa, Artificial Sequence
  Synthetic Polypeptide
MQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTR

SEQ ID NO: 6268 - protein, 242 aa, Artificial Sequence
  Synthetic Polypeptide
MDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTR

SEQ ID NO: 6269 - protein, 253 aa, Artificial Sequence
  Synthetic Polypeptide
MAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTR

SEQ ID NO: 6270 - protein, 248 aa, Artificial Sequence
  Synthetic Polypeptide
MDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTR

SEQ ID NO: 6271 - protein, 249 aa, Artificial Sequence
  Synthetic Polypeptide
MDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTR

SEQ ID NO: 6272 - protein, 249 aa, Artificial Sequence
  Synthetic Polypeptide
MDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTR

SEQ ID NO: 6273 - protein, 249 aa, Artificial Sequence
  Synthetic Polypeptide
MQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTR

SEQ ID NO: 6274 - protein, 243 aa, Artificial Sequence
  Synthetic Polypeptide
MDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTR

SEQ ID NO: 6275 - protein, 245 aa, Artificial Sequence
  Synthetic Polypeptide
MEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTR

SEQ ID NO: 6276 - protein, 244 aa, Artificial Sequence
  Synthetic Polypeptide
MELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTR

SEQ ID NO: 6277 - protein, 246 aa, Artificial Sequence
  Synthetic Polypeptide
MDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTR

SEQ ID NO: 6278 - protein, 237 aa, Artificial Sequence
  Synthetic Polypeptide
MDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTR

SEQ ID NO: 6279 - protein, 240 aa, Artificial Sequence
  Synthetic Polypeptide
MDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTR

SEQ ID NO: 6280 - protein, 247 aa, Artificial Sequence
  Synthetic Polypeptide
MDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTR

SEQ ID NO: 6281 - protein, 243 aa, Artificial Sequence
  Synthetic Polypeptide
MDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTR

SEQ ID NO: 6282 - protein, 244 aa, Artificial Sequence
  Synthetic Polypeptide
MEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTR

SEQ ID NO: 6283 - protein, 245 aa, Artificial Sequence
  Synthetic Polypeptide
MEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTR

SEQ ID NO: 6284 - protein, 250 aa, Artificial Sequence
  Synthetic Polypeptide
MDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTR

SEQ ID NO: 6285 - protein, 257 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDL

SEQ ID NO: 6286 - protein, 251 aa, Artificial Sequence
  Synthetic Polypeptide
MEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSTREQKLISEEDL

SEQ ID NO: 6287 - protein, 256 aa, Artificial Sequence
  Synthetic Polypeptide
MDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREQKLISEEDL

SEQ ID NO: 6288 - protein, 253 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREQKLISEEDL

SEQ ID NO: 6289 - protein, 258 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREQKLISEEDL

SEQ ID NO: 6290 - protein, 263 aa, Artificial Sequence
  Synthetic Polypeptide
MDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREQKLISEEDL

SEQ ID NO: 6291 - protein, 268 aa, Artificial Sequence
  Synthetic Polypeptide
MDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREQKLISEEDL

SEQ ID NO: 6292 - protein, 259 aa, Artificial Sequence
  Synthetic Polypeptide
MEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREQKLISEEDL

SEQ ID NO: 6293 - protein, 255 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREQKLISEEDL

SEQ ID NO: 6294 - protein, 260 aa, Artificial Sequence
  Synthetic Polypeptide
MDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREQKLISEEDL

SEQ ID NO: 6295 - protein, 250 aa, Artificial Sequence
  Synthetic Polypeptide
MDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREQKLISEEDL

SEQ ID NO: 6296 - protein, 250 aa, Artificial Sequence
  Synthetic Polypeptide
MEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREQKLISEEDL

SEQ ID NO: 6297 - protein, 254 aa, Artificial Sequence
  Synthetic Polypeptide
MEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREQKLISEEDL

SEQ ID NO: 6298 - protein, 258 aa, Artificial Sequence
  Synthetic Polypeptide
MDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREQKLISEEDL

SEQ ID NO: 6299 - protein, 258 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREQKLISEEDL

SEQ ID NO: 6300 - protein, 260 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREQKLISEEDL

SEQ ID NO: 6301 - protein, 260 aa, Artificial Sequence
  Synthetic Polypeptide
MDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREQKLISEEDL

SEQ ID NO: 6302 - protein, 257 aa, Artificial Sequence
  Synthetic Polypeptide
MEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSTREQKLISEEDL

SEQ ID NO: 6303 - protein, 257 aa, Artificial Sequence
  Synthetic Polypeptide
MQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRTREQKLISEEDL

SEQ ID NO: 6304 - protein, 263 aa, Artificial Sequence
  Synthetic Polypeptide
MDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREQKLISEEDL

SEQ ID NO: 6305 - protein, 263 aa, Artificial Sequence
  Synthetic Polypeptide
MQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRTREQKLISEEDL

SEQ ID NO: 6306 - protein, 253 aa, Artificial Sequence
  Synthetic Polypeptide
MDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREQKLISEEDL

SEQ ID NO: 6307 - protein, 253 aa, Artificial Sequence
  Synthetic Polypeptide
MQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKTREQKLISEEDL

SEQ ID NO: 6308 - protein, 241 aa, Artificial Sequence
  Synthetic Polypeptide
MEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQYAAETDLGRGSV

SEQ ID NO: 6309 - protein, 241 aa, Artificial Sequence; identical to SEQ ID NO: 6308
  Synthetic Polypeptide

SEQ ID NO: 6310 - protein, 244 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQYAAETDLGRGSV

SEQ ID NO: 6311 - protein, 244 aa, Artificial Sequence; identical to SEQ ID NO: 6310
  Synthetic Polypeptide

SEQ ID NO: 6312 - protein, 258 aa, Artificial Sequence
  Synthetic Polypeptide
MDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSTREQKLISEEDL

SEQ ID NO: 6313 - protein, 258 aa, Artificial Sequence
  Synthetic Polypeptide
MQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTREQKLISEEDL

SEQ ID NO: 6314 - protein, 261 aa, Artificial Sequence
  Synthetic Polypeptide
MQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSTREQKLISEEDL

SEQ ID NO: 6315 - protein, 261 aa, Artificial Sequence
  Synthetic Polypeptide
MQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQTREQKLISEEDL

SEQ ID NO: 6316 - protein, 253 aa, Artificial Sequence
  Synthetic Polypeptide
MDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSTREQKLISEEDL

SEQ ID NO: 6317 - protein, 253 aa, Artificial Sequence
  Synthetic Polypeptide
MQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRTREQKLISEEDL

SEQ ID NO: 6318 - protein, 261 aa, Artificial Sequence
  Synthetic Polypeptide
MDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREQKLISEEDL

SEQ ID NO: 6319 - protein, 261 aa, Artificial Sequence
  Synthetic Polypeptide
MQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRTREQKLISEEDL

SEQ ID NO: 6320 - protein, 256 aa, Artificial Sequence
  Synthetic Polypeptide
MDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREQKLISEEDL

SEQ ID NO: 6321 - protein, 256 aa, Artificial Sequence
  Synthetic Polypeptide
MEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTREQKLISEEDL

SEQ ID NO: 6322 - protein, 253 aa, Artificial Sequence
  Synthetic Polypeptide
MDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREQKLISEEDL

SEQ ID NO: 6323 - protein, 253 aa, Artificial Sequence
  Synthetic Polypeptide
MEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRTREQKLISEEDL

SEQ ID NO: 6324 - protein, 253 aa, Artificial Sequence
  Synthetic Polypeptide
MDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREQKLISEEDL

SEQ ID NO: 6325 - protein, 253 aa, Artificial Sequence
  Synthetic Polypeptide
MEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVTREQKLISEEDL

SEQ ID NO: 6326 - protein, 261 aa, Artificial Sequence
  Synthetic Polypeptide
MQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREQKLISEEDL

SEQ ID NO: 6327 - protein, 261 aa, Artificial Sequence
  Synthetic Polypeptide
MQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGTREQKLISEEDL

SEQ ID NO: 6328 - protein, 268 aa, Artificial Sequence
  Synthetic Polypeptide
MDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREQKLISEEDL

SEQ ID NO: 6329 - protein, 268 aa, Artificial Sequence
  Synthetic Polypeptide
MEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVTREQKLISEEDL

SEQ ID NO: 6330 - protein, 241 aa, Artificial Sequence
  Synthetic Polypeptide
MVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSTR

SEQ ID NO: 6331 - protein, 244 aa, Artificial Sequence
  Synthetic Polypeptide
MEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSTR

SEQ ID NO: 6332 - protein, 249 aa, Artificial Sequence
  Synthetic Polypeptide
MDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSTR

SEQ ID NO: 6333 - protein, 252 aa, Artificial Sequence
  Synthetic Polypeptide
MDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSTR

SEQ ID NO: 6334 - protein, 250 aa, Artificial Sequence
  Synthetic Polypeptide
MDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSTR

SEQ ID NO: 6335 - protein, 251 aa, Artificial Sequence
  Synthetic Polypeptide
MDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTR

SEQ ID NO: 6336 - protein, 247 aa, Artificial Sequence
  Synthetic Polypeptide
MDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSTR

SEQ ID NO: 6337 - protein, 249 aa, Artificial Sequence
  Synthetic Polypeptide
MSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKTR

SEQ ID NO: 6338 - protein, 244 aa, Artificial Sequence
  Synthetic Polypeptide
MQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSATR

SEQ ID NO: 6339 - protein, 245 aa, Artificial Sequence
  Synthetic Polypeptide
MDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSTR

SEQ ID NO: 6340 - skipped

SEQ ID NO: 6341 - protein, 247 aa, Artificial Sequence
  Synthetic Polypeptide
MDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSKDEL

SEQ ID NO: 6342 - protein, 247 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSKDEL

SEQ ID NO: 6343 - protein, 247 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSKDEL

SEQ ID NO: 6344 - protein, 248 aa, Artificial Sequence
  Synthetic Polypeptide
MDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSKDEL

SEQ ID NO: 6345 - protein, 255 aa, Artificial Sequence
  Synthetic Polypeptide
MDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSKDEL

SEQ ID NO: 6346 - protein, 272 aa, Artificial Sequence
  Synthetic Polypeptide
MINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSKDEL

SEQ ID NO: 6347 - protein, 249 aa, Artificial Sequence
  Synthetic Polypeptide
MDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSKDEL

SEQ ID NO: 6348 - protein, 248 aa, Artificial Sequence
  Synthetic Polypeptide
MQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSKDEL

SEQ ID NO: 6349 - protein, 254 aa, Artificial Sequence
  Synthetic Polypeptide
MQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSKDEL

SEQ ID NO: 6350 - protein, 259 aa, Artificial Sequence
  Synthetic Polypeptide
MQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSKDEL

SEQ ID NO: 6351 - protein, 246 aa, Artificial Sequence
  Synthetic Polypeptide
MDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAKDEL

SEQ ID NO: 6352 - protein, 256 aa, Artificial Sequence
  Synthetic Polypeptide
MDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSKDEL

SEQ ID NO: 6353 - protein, 247 aa, Artificial Sequence
  Synthetic Polypeptide
MDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSKDEL

SEQ ID NO: 6354 - protein, 251 aa, Artificial Sequence
  Synthetic Polypeptide
MDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSKDEL

SEQ ID NO: 6355 - protein, 249 aa, Artificial Sequence
  Synthetic Polypeptide
MDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSKDEL

SEQ ID NO: 6356 - protein, 249 aa, Artificial Sequence
  Synthetic Polypeptide
MDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSKDEL

SEQ ID NO: 6357 - protein, 250 aa, Artificial Sequence
  Synthetic Polypeptide
MQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSKDEL

SEQ ID NO: 6358 - protein, 248 aa, Artificial Sequence
  Synthetic Polypeptide
MQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSKDEL

SEQ ID NO: 6359 - protein, 259 aa, Artificial Sequence
  Synthetic Polypeptide
MLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSKDEL

SEQ ID NO: 6360 - protein, 248 aa, Artificial Sequence
  Synthetic Polypeptide
MDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSKDEL

SEQ ID NO: 6361 - protein, 249 aa, Artificial Sequence
  Synthetic Polypeptide
MDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSKDEL

SEQ ID NO: 6362 - protein, 250 aa, Artificial Sequence
  Synthetic Polypeptide
MDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSKDEL

SEQ ID NO: 6363 - protein, 250 aa, Artificial Sequence
  Synthetic Polypeptide
MDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSKDEL

SEQ ID NO: 6364 - protein, 250 aa, Artificial Sequence; identical to SEQ ID NO: 6363
  Synthetic Polypeptide

SEQ ID NO: 6365 - protein, 250 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSKDEL

SEQ ID NO: 6366 - protein, 252 aa, Artificial Sequence
  Synthetic Polypeptide
MDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSKDEL

SEQ ID NO: 6367 - protein, 249 aa, Artificial Sequence
  Synthetic Polypeptide
MDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSKDEL

SEQ ID NO: 6368 - protein, 252 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSKDEL

SEQ ID NO: 6369 - protein, 250 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSKDEL

SEQ ID NO: 6370 - protein, 249 aa, Artificial Sequence
  Synthetic Polypeptide
MDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSKDEL

SEQ ID NO: 6371 - protein, 259 aa, Artificial Sequence
  Synthetic Polypeptide
MSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTKDEL

SEQ ID NO: 6372 - protein, 251 aa, Artificial Sequence
  Synthetic Polypeptide
MQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASKDEL

SEQ ID NO: 6373 - protein, 249 aa, Artificial Sequence; identical to SEQ ID NO: 6370
  Synthetic Polypeptide

SEQ ID NO: 6374 - protein, 248 aa, Artificial Sequence
  Synthetic Polypeptide
MEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSKDEL

SEQ ID NO: 6375 - protein, 250 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSKDEL

SEQ ID NO: 6376 - protein, 248 aa, Artificial Sequence
  Synthetic Polypeptide
MEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSKDEL

SEQ ID NO: 6377 - protein, 253 aa, Artificial Sequence
  Synthetic Polypeptide
MDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSKDEL

SEQ ID NO: 6378 - protein, 245 aa, Artificial Sequence
  Synthetic Polypeptide
MDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSKDEL

SEQ ID NO: 6379 - protein, 251 aa, Artificial Sequence
  Synthetic Polypeptide
MDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSKDEL

SEQ ID NO: 6380 - protein, 251 aa, Artificial Sequence
  Synthetic Polypeptide
MQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKKDEL

SEQ ID NO: 6381 - protein, 244 aa, Artificial Sequence
  Synthetic Polypeptide
MDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSKDEL

SEQ ID NO: 6382 - protein, 249 aa, Artificial Sequence
  Synthetic Polypeptide
MDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSKDEL

SEQ ID NO: 6383 - protein, 246 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSKDEL

SEQ ID NO: 6384 - protein, 256 aa, Artificial Sequence
  Synthetic Polypeptide
MDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSKDEL

SEQ ID NO: 6385 - protein, 252 aa, Artificial Sequence
  Synthetic Polypeptide
MDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSKDEL

SEQ ID NO: 6386 - protein, 278 aa, Artificial Sequence
  Synthetic Polypeptide
MYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASKDEL

SEQ ID NO: 6387 - protein, 277 aa, Artificial Sequence
  Synthetic Polypeptide
MYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERKDEL

SEQ ID NO: 6388 - protein, 293 aa, Artificial Sequence
  Synthetic Polypeptide
MDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDIKDEL

SEQ ID NO: 6389 - protein, 249 aa, Artificial Sequence
  Synthetic Polypeptide
MEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSKDEL

SEQ ID NO: 6390 - protein, 248 aa, Artificial Sequence
  Synthetic Polypeptide
MDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSKDEL

SEQ ID NO: 6391 - protein, 245 aa, Artificial Sequence
  Synthetic Polypeptide
MDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSKDEL

SEQ ID NO: 6392 - protein, 255 aa, Artificial Sequence
  Synthetic Polypeptide
MDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSKDEL

SEQ ID NO: 6393 - protein, 242 aa, Artificial Sequence
  Synthetic Polypeptide
MDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSKDEL

SEQ ID NO: 6394 - protein, 250 aa, Artificial Sequence
  Synthetic Polypeptide
MDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSKDEL

SEQ ID NO: 6395 - protein, 246 aa, Artificial Sequence
  Synthetic Polypeptide
MDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSKDEL

SEQ ID NO: 6396 - protein, 250 aa, Artificial Sequence
  Synthetic Polypeptide
MDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSKDEL

SEQ ID NO: 6397 - protein, 246 aa, Artificial Sequence
  Synthetic Polypeptide
MDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSKDEL

SEQ ID NO: 6398 - protein, 254 aa, Artificial Sequence
  Synthetic Polypeptide
MDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSKDEL

SEQ ID NO: 6399 - protein, 249 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSKDEL

SEQ ID NO: 6400 - protein, 253 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSKDEL

SEQ ID NO: 6401 - protein, 253 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSKDEL

SEQ ID NO: 6402 - protein, 247 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSKDEL

SEQ ID NO: 6403 - protein, 249 aa, Artificial Sequence
  Synthetic Polypeptide
MQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSKDEL

SEQ ID NO: 6404 - protein, 246 aa, Artificial Sequence
  Synthetic Polypeptide
MDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSKDEL

SEQ ID NO: 6405 - protein, 247 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSKDEL

SEQ ID NO: 6406 - protein, 243 aa, Artificial Sequence
  Synthetic Polypeptide
MDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSKDEL

SEQ ID NO: 6407 - protein, 274 aa, Artificial Sequence
  Synthetic Polypeptide
MYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSKDEL

SEQ ID NO: 6408 - protein, 245 aa, Artificial Sequence
  Synthetic Polypeptide
MEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSKDEL

SEQ ID NO: 6409 - protein, 254 aa, Artificial Sequence
  Synthetic Polypeptide
MDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSKDEL

SEQ ID NO: 6410 - protein, 258 aa, Artificial Sequence
  Synthetic Polypeptide
MDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSKDEL

SEQ ID NO: 6411 - protein, 249 aa, Artificial Sequence
  Synthetic Polypeptide
MDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSKDEL

SEQ ID NO: 6412 - protein, 244 aa, Artificial Sequence
  Synthetic Polypeptide
MDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSKDEL

SEQ ID NO: 6413 - protein, 247 aa, Artificial Sequence
  Synthetic Polypeptide
MEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSKDEL

SEQ ID NO: 6414 - protein, 242 aa, Artificial Sequence
  Synthetic Polypeptide
MQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSAKDEL

SEQ ID NO: 6415 - protein, 252 aa, Artificial Sequence
  Synthetic Polypeptide
MDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSKDEL

SEQ ID NO: 6416 - protein, 244 aa, Artificial Sequence
  Synthetic Polypeptide
MDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSKDEL

SEQ ID NO: 6417 - protein, 247 aa, Artificial Sequence
  Synthetic Polypeptide
MDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSKDEL

SEQ ID NO: 6418 - protein, 257 aa, Artificial Sequence
  Synthetic Polypeptide
MDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSKDEL

SEQ ID NO: 6419 - protein, 254 aa, Artificial Sequence
  Synthetic Polypeptide
MEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSKDEL

SEQ ID NO: 6420 - protein, 246 aa, Artificial Sequence
  Synthetic Polypeptide
MDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAKDEL

SEQ ID NO: 6421 - protein, 239 aa, Artificial Sequence
  Synthetic Polypeptide
MMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSKDEL

SEQ ID NO: 6422 - protein, 244 aa, Artificial Sequence
  Synthetic Polypeptide
MQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSKDEL

SEQ ID NO: 6423 - protein, 247 aa, Artificial Sequence
  Synthetic Polypeptide
MDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSKDEL

SEQ ID NO: 6424 - protein, 252 aa, Artificial Sequence
  Synthetic Polypeptide
MDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSKDEL

SEQ ID NO: 6425 - protein, 247 aa, Artificial Sequence
  Synthetic Polypeptide
MDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSKDEL

SEQ ID NO: 6426 - protein, 253 aa, Artificial Sequence
  Synthetic Polypeptide
MDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSKDEL

SEQ ID NO: 6427 - protein, 251 aa, Artificial Sequence
  Synthetic Polypeptide
MEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSKDEL

SEQ ID NO: 6428 - protein, 251 aa, Artificial Sequence
  Synthetic Polypeptide
MEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSKDEL

SEQ ID NO: 6429 - protein, 249 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSKDEL

SEQ ID NO: 6430 - protein, 246 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSKDEL

SEQ ID NO: 6431 - protein, 247 aa, Artificial Sequence
  Synthetic Polypeptide
MDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSKDEL

SEQ ID NO: 6432 - protein, 249 aa, Artificial Sequence
  Synthetic Polypeptide
MDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSKDEL

SEQ ID NO: 6433 - protein, 250 aa, Artificial Sequence
  Synthetic Polypeptide
MDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSKDEL

SEQ ID NO: 6434 - protein, 250 aa, Artificial Sequence
  Synthetic Polypeptide
MDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSKDEL

SEQ ID NO: 6435 - protein, 250 aa, Artificial Sequence
  Synthetic Polypeptide
MDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSKDEL

SEQ ID NO: 6436 - protein, 248 aa, Artificial Sequence
  Synthetic Polypeptide
MDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAKDEL

SEQ ID NO: 6437 - protein, 248 aa, Artificial Sequence
  Synthetic Polypeptide
MDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSKDEL

SEQ ID NO: 6438 - protein, 253 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSKDEL

SEQ ID NO: 6439 - protein, 253 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSKDEL

SEQ ID NO: 6440 - protein, 251 aa, Artificial Sequence
  Synthetic Polypeptide
MDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSKDEL

SEQ ID NO: 6441 - protein, 246 aa, Artificial Sequence
  Synthetic Polypeptide
MEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSKDEL

SEQ ID NO: 6442 - protein, 241 aa, Artificial Sequence
  Synthetic Polypeptide
MDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSKDEL

SEQ ID NO: 6443 - protein, 247 aa, Artificial Sequence
  Synthetic Polypeptide
MDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKKDEL

SEQ ID NO: 6444 - protein, 254 aa, Artificial Sequence
  Synthetic Polypeptide
MDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSKDEL

SEQ ID NO: 6445 - protein, 255 aa, Artificial Sequence
  Synthetic Polypeptide
MDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSKDEL

SEQ ID NO: 6446 - protein, 252 aa, Artificial Sequence
  Synthetic Polypeptide
MDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSKDEL

SEQ ID NO: 6447 - protein, 249 aa, Artificial Sequence
  Synthetic Polypeptide
MDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSKDEL

SEQ ID NO: 6448 - protein, 260 aa, Artificial Sequence
  Synthetic Polypeptide
MDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTKDEL

SEQ ID NO: 6449 - protein, 256 aa, Artificial Sequence
  Synthetic Polypeptide
MQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGKDEL

SEQ ID NO: 6450 - protein, 250 aa, Artificial Sequence
  Synthetic Polypeptide
MDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSKDEL

SEQ ID NO: 6451 - protein, 247 aa, Artificial Sequence
  Synthetic Polypeptide
MDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSKDEL

SEQ ID NO: 6452 - protein, 245 aa, Artificial Sequence
  Synthetic Polypeptide
MDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSKDEL

SEQ ID NO: 6453 - protein, 247 aa, Artificial Sequence
  Synthetic Polypeptide
MDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSKDEL

SEQ ID NO: 6454 - protein, 249 aa, Artificial Sequence
  Synthetic Polypeptide
MQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSKDEL

SEQ ID NO: 6455 - protein, 254 aa, Artificial Sequence
  Synthetic Polypeptide
MQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSKDEL

SEQ ID NO: 6456 - protein, 248 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSKDEL

SEQ ID NO: 6457 - protein, 249 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSKDEL

SEQ ID NO: 6458 - protein, 248 aa, Artificial Sequence
  Synthetic Polypeptide
MQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSKDEL

SEQ ID NO: 6459 - protein, 247 aa, Artificial Sequence
  Synthetic Polypeptide
MQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVKDEL

SEQ ID NO: 6460 - protein, 247 aa, Artificial Sequence
  Synthetic Polypeptide
MQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSKDEL

SEQ ID NO: 6461 - protein, 249 aa, Artificial Sequence
  Synthetic Polypeptide
MQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSKDEL

SEQ ID NO: 6462 - protein, 247 aa, Artificial Sequence
  Synthetic Polypeptide
MDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSAKDEL

SEQ ID NO: 6463 - protein, 246 aa, Artificial Sequence
  Synthetic Polypeptide
MDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSKDEL

SEQ ID NO: 6464 - protein, 246 aa, Artificial Sequence
  Synthetic Polypeptide
MDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSKDEL

SEQ ID NO: 6465 - protein, 254 aa, Artificial Sequence
  Synthetic Polypeptide
MDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPKDEL

SEQ ID NO: 6466 - protein, 260 aa, Artificial Sequence
  Synthetic Polypeptide
MQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSKDEL

SEQ ID NO: 6467 - protein, 245 aa, Artificial Sequence
  Synthetic Polypeptide
MEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSKDEL

SEQ ID NO: 6468 - protein, 255 aa, Artificial Sequence
  Synthetic Polypeptide
MELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSKDEL

SEQ ID NO: 6469 - protein, 251 aa, Artificial Sequence
  Synthetic Polypeptide
MDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSKDEL

SEQ ID NO: 6470 - protein, 235 aa, Artificial Sequence
  Synthetic Polypeptide
MDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSKDEL

SEQ ID NO: 6471 - protein, 245 aa, Artificial Sequence
  Synthetic Polypeptide
MDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSKDEL

SEQ ID NO: 6472 - protein, 249 aa, Artificial Sequence
  Synthetic Polypeptide
MDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSKDEL

SEQ ID NO: 6473 - protein, 245 aa, Artificial Sequence
  Synthetic Polypeptide
MDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSKDEL

SEQ ID NO: 6474 - protein, 246 aa, Artificial Sequence
  Synthetic Polypeptide
MDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSKDEL

SEQ ID NO: 6475 - protein, 251 aa, Artificial Sequence
  Synthetic Polypeptide
MDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSKDEL

SEQ ID NO: 6476 - protein, 245 aa, Artificial Sequence
  Synthetic Polypeptide
MDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSKDEL

SEQ ID NO: 6477 - protein, 246 aa, Artificial Sequence
  Synthetic Polypeptide
MDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAAKDEL

SEQ ID NO: 6478 - protein, 254 aa, Artificial Sequence
  Synthetic Polypeptide
MDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASKDEL

SEQ ID NO: 6479 - protein, 250 aa, Artificial Sequence; identical to SEQ ID NO: 6396
  Synthetic Polypeptide

SEQ ID NO: 6480 - protein, 247 aa, Artificial Sequence
  Synthetic Polypeptide
MDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSKDEL

SEQ ID NO: 6481 - protein, 247 aa, Artificial Sequence
  Synthetic Polypeptide
MDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSKDEL

SEQ ID NO: 6482 - protein, 246 aa, Artificial Sequence
  Synthetic Polypeptide
MDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSKDEL

SEQ ID NO: 6483 - protein, 245 aa, Artificial Sequence
  Synthetic Polypeptide
MDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINKDEL

SEQ ID NO: 6484 - protein, 246 aa, Artificial Sequence
  Synthetic Polypeptide
MDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSKDEL

SEQ ID NO: 6485 - protein, 250 aa, Artificial Sequence
  Synthetic Polypeptide
MDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSKDEL

SEQ ID NO: 6486 - protein, 253 aa, Artificial Sequence
  Synthetic Polypeptide
MDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSKDEL

SEQ ID NO: 6487 - protein, 255 aa, Artificial Sequence
  Synthetic Polypeptide
MDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSKDEL

SEQ ID NO: 6488 - protein, 254 aa, Artificial Sequence
  Synthetic Polypeptide
MDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSKDEL

SEQ ID NO: 6489 - protein, 244 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSKDEL

SEQ ID NO: 6490 - protein, 246 aa, Artificial Sequence
  Synthetic Polypeptide
MDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSKDEL

SEQ ID NO: 6491 - protein, 246 aa, Artificial Sequence
  Synthetic Polypeptide
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSKDEL

SEQ ID NO: 6492 - protein, 247 aa, Artificial Sequence
  Synthetic Polypeptide
MAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSKDEL

SEQ ID NO: 6493 - protein, 245 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSKDEL

SEQ ID NO: 6494 - protein, 264 aa, Artificial Sequence
  Synthetic Polypeptide
MDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSKDEL

SEQ ID NO: 6495 - protein, 261 aa, Artificial Sequence
  Synthetic Polypeptide
MDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSKDEL

SEQ ID NO: 6496 - protein, 235 aa, Artificial Sequence
  Synthetic Polypeptide
MDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSKDEL

SEQ ID NO: 6497 - protein, 251 aa, Artificial Sequence
  Synthetic Polypeptide
MDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSKDEL

SEQ ID NO: 6498 - protein, 242 aa, Artificial Sequence
  Synthetic Polypeptide
MDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSKDEL

SEQ ID NO: 6499 - protein, 243 aa, Artificial Sequence
  Synthetic Polypeptide
MDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSKDEL

SEQ ID NO: 6500 - protein, 243 aa, Artificial Sequence
  Synthetic Polypeptide
MDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSAKDEL

SEQ ID NO: 6501 - protein, 254 aa, Artificial Sequence
  Synthetic Polypeptide
MEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSKDEL

SEQ ID NO: 6502 - protein, 250 aa, Artificial Sequence
  Synthetic Polypeptide
MQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSKDEL

SEQ ID NO: 6503 - protein, 245 aa, Artificial Sequence
  Synthetic Polypeptide
MENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSKDEL

SEQ ID NO: 6504 - protein, 249 aa, Artificial Sequence
  Synthetic Polypeptide
MDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSKDEL

SEQ ID NO: 6505 - protein, 258 aa, Artificial Sequence
  Synthetic Polypeptide
MDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSKDEL

SEQ ID NO: 6506 - protein, 249 aa, Artificial Sequence
  Synthetic Polypeptide
MDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSKDEL

SEQ ID NO: 6507 - protein, 252 aa, Artificial Sequence
  Synthetic Polypeptide
MDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSKDEL

SEQ ID NO: 6508 - protein, 247 aa, Artificial Sequence
  Synthetic Polypeptide
MDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSAKDEL

SEQ ID NO: 6509 - protein, 248 aa, Artificial Sequence
  Synthetic Polypeptide
MEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSKDEL

SEQ ID NO: 6510 - protein, 245 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSKDEL

SEQ ID NO: 6511 - protein, 257 aa, Artificial Sequence
  Synthetic Polypeptide
MDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSKDEL

SEQ ID NO: 6512 - protein, 247 aa, Artificial Sequence
  Synthetic Polypeptide
MEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSKDEL

SEQ ID NO: 6513 - protein, 244 aa, Artificial Sequence
  Synthetic Polypeptide
MDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSKDEL

SEQ ID NO: 6514 - protein, 249 aa, Artificial Sequence
  Synthetic Polypeptide
MDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSKDEL

SEQ ID NO: 6515 - protein, 248 aa, Artificial Sequence
  Synthetic Polypeptide
MDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSKDEL

SEQ ID NO: 6516 - protein, 250 aa, Artificial Sequence
  Synthetic Polypeptide
MDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSKDEL

SEQ ID NO: 6517 - protein, 246 aa, Artificial Sequence
  Synthetic Polypeptide
MQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSKDEL

SEQ ID NO: 6518 - protein, 244 aa, Artificial Sequence
  Synthetic Polypeptide
MDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSKDEL

SEQ ID NO: 6519 - protein, 255 aa, Artificial Sequence
  Synthetic Polypeptide
MAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSKDEL

SEQ ID NO: 6520 - protein, 250 aa, Artificial Sequence
  Synthetic Polypeptide
MDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSKDEL

SEQ ID NO: 6521 - protein, 251 aa, Artificial Sequence
  Synthetic Polypeptide
MDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSKDEL

SEQ ID NO: 6522 - protein, 251 aa, Artificial Sequence
  Synthetic Polypeptide
MDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSKDEL

SEQ ID NO: 6523 - protein, 251 aa, Artificial Sequence
  Synthetic Polypeptide
MQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSKDEL

SEQ ID NO: 6524 - protein, 245 aa, Artificial Sequence
  Synthetic Polypeptide
MDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSKDEL

SEQ ID NO: 6525 - protein, 247 aa, Artificial Sequence
  Synthetic Polypeptide
MEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSKDEL

SEQ ID NO: 6526 - protein, 246 aa, Artificial Sequence
  Synthetic Polypeptide
MELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSKDEL

SEQ ID NO: 6527 - protein, 248 aa, Artificial Sequence
  Synthetic Polypeptide
MDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSKDEL

SEQ ID NO: 6528 - protein, 239 aa, Artificial Sequence
  Synthetic Polypeptide
MDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSKDEL

SEQ ID NO: 6529 - protein, 242 aa, Artificial Sequence
  Synthetic Polypeptide
MDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSKDEL

SEQ ID NO: 6530 - protein, 249 aa, Artificial Sequence
  Synthetic Polypeptide
MDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSKDEL

SEQ ID NO: 6531 - protein, 245 aa, Artificial Sequence
  Synthetic Polypeptide
MDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSKDEL

SEQ ID NO: 6532 - protein, 246 aa, Artificial Sequence
  Synthetic Polypeptide
MEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSKDEL

SEQ ID NO: 6533 - protein, 247 aa, Artificial Sequence
  Synthetic Polypeptide
MEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSKDEL

SEQ ID NO: 6534 - protein, 252 aa, Artificial Sequence
  Synthetic Polypeptide
MDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSKDEL

SEQ ID NO: 6535 - protein, 259 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSKDELEQKLISEEDL

SEQ ID NO: 6536 - protein, 253 aa, Artificial Sequence
  Synthetic Polypeptide
MEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSKDELEQKLISEEDL

SEQ ID NO: 6537 - protein, 258 aa, Artificial Sequence
  Synthetic Polypeptide
MDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSKDELEQKLISEEDL

SEQ ID NO: 6538 - protein, 255 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSKDELEQKLISEEDL

SEQ ID NO: 6539 - protein, 260 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSKDELEQKLISEEDL

SEQ ID NO: 6540 - protein, 265 aa, Artificial Sequence
  Synthetic Polypeptide
MDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSKDELEQKLISEEDL

SEQ ID NO: 6541 - protein, 270 aa, Artificial Sequence
  Synthetic Polypeptide
MDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSKDELEQKLISEEDL

SEQ ID NO: 6542 - protein, 261 aa, Artificial Sequence
  Synthetic Polypeptide
MEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSKDELEQKLISEEDL

SEQ ID NO: 6543 - protein, 257 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSKDELEQKLISEEDL

SEQ ID NO: 6544 - protein, 262 aa, Artificial Sequence
  Synthetic Polypeptide
MDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSKDELEQKLISEEDL

SEQ ID NO: 6545 - protein, 252 aa, Artificial Sequence
  Synthetic Polypeptide
MDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSKDELEQKLISEEDL

SEQ ID NO: 6546 - protein, 252 aa, Artificial Sequence
  Synthetic Polypeptide
MEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSKDELEQKLISEEDL

SEQ ID NO: 6547 - protein, 256 aa, Artificial Sequence
  Synthetic Polypeptide
MEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSKDELEQKLISEEDL

SEQ ID NO: 6548 - protein, 260 aa, Artificial Sequence
  Synthetic Polypeptide
MDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAKDELEQKLISEEDL

SEQ ID NO: 6549 - protein, 260 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSKDELEQKLISEEDL

SEQ ID NO: 6550 - protein, 262 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSKDELEQKLISEEDL

SEQ ID NO: 6551 - protein, 262 aa, Artificial Sequence
  Synthetic Polypeptide
MDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSKDELEQKLISEEDL

SEQ ID NO: 6552 - protein, 259 aa, Artificial Sequence
  Synthetic Polypeptide
MEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSKDELEQKLISEEDL

SEQ ID NO: 6553 - protein, 259 aa, Artificial Sequence
  Synthetic Polypeptide
MQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRKDELEQKLISEEDL

SEQ ID NO: 6554 - protein, 265 aa, Artificial Sequence
  Synthetic Polypeptide
MDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSKDELEQKLISEEDL

SEQ ID NO: 6555 - protein, 265 aa, Artificial Sequence
  Synthetic Polypeptide
MQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRKDELEQKLISEEDL

SEQ ID NO: 6556 - protein, 255 aa, Artificial Sequence
  Synthetic Polypeptide
MDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSKDELEQKLISEEDL

SEQ ID NO: 6557 - protein, 255 aa, Artificial Sequence
  Synthetic Polypeptide
MQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKKDELEQKLISEEDL

SEQ ID NO: 6558 - protein, 242 aa, Artificial Sequence
  Synthetic Polypeptide
MEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQGAGAETDLGRGSV

SEQ ID NO: 6559 - protein, 242 aa, Artificial Sequence; identical to SEQ ID NO: 6558
  Synthetic Polypeptide

SEQ ID NO: 6560 - protein, 245 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQGAGAETDLGRGSV

SEQ ID NO: 6561 - protein, 245 aa, Artificial Sequence; identical to SEQ ID NO: 6560
  Synthetic Polypeptide

SEQ ID NO: 6562 - protein, 260 aa, Artificial Sequence
  Synthetic Polypeptide
MDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSKDELEQKLISEEDL

SEQ ID NO: 6563 - protein, 260 aa, Artificial Sequence
  Synthetic Polypeptide
MQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRKDELEQKLISEEDL

SEQ ID NO: 6564 - protein, 263 aa, Artificial Sequence
  Synthetic Polypeptide
MQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSKDELEQKLISEEDL

SEQ ID NO: 6565 - protein, 263 aa, Artificial Sequence
  Synthetic Polypeptide
MQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQKDELEQKLISEEDL

SEQ ID NO: 6566 - protein, 255 aa, Artificial Sequence
  Synthetic Polypeptide
MDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSKDELEQKLISEEDL

SEQ ID NO: 6567 - protein, 255 aa, Artificial Sequence
  Synthetic Polypeptide
MQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRKDELEQKLISEEDL

SEQ ID NO: 6568 - protein, 263 aa, Artificial Sequence
  Synthetic Polypeptide
MDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSKDELEQKLISEEDL

SEQ ID NO: 6569 - protein, 263 aa, Artificial Sequence
  Synthetic Polypeptide
MQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRKDELEQKLISEEDL

SEQ ID NO: 6570 - protein, 258 aa, Artificial Sequence
  Synthetic Polypeptide
MDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSKDELEQKLISEEDL

SEQ ID NO: 6571 - protein, 258 aa, Artificial Sequence
  Synthetic Polypeptide
MEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRKDELEQKLISEEDL

SEQ ID NO: 6572 - protein, 255 aa, Artificial Sequence
  Synthetic Polypeptide
MDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSKDELEQKLISEEDL

SEQ ID NO: 6573 - protein, 255 aa, Artificial Sequence
  Synthetic Polypeptide
MEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRKDELEQKLISEEDL

SEQ ID NO: 6574 - protein, 255 aa, Artificial Sequence
  Synthetic Polypeptide
MDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSKDELEQKLISEEDL

SEQ ID NO: 6575 - protein, 255 aa, Artificial Sequence
  Synthetic Polypeptide
MEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVKDELEQKLISEEDL

SEQ ID NO: 6576 - protein, 263 aa, Artificial Sequence
  Synthetic Polypeptide
MQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSKDELEQKLISEEDL

SEQ ID NO: 6577 - protein, 263 aa, Artificial Sequence
  Synthetic Polypeptide
MQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGKDELEQKLISEEDL

SEQ ID NO: 6578 - protein, 270 aa, Artificial Sequence
  Synthetic Polypeptide
MDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSKDELEQKLISEEDL

SEQ ID NO: 6579 - protein, 270 aa, Artificial Sequence
  Synthetic Polypeptide
MEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVKDELEQKLISEEDL

SEQ ID NO: 6580 - protein, 243 aa, Artificial Sequence
  Synthetic Polypeptide
MVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSKDEL

SEQ ID NO: 6581 - protein, 246 aa, Artificial Sequence
  Synthetic Polypeptide
MEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSKDEL

SEQ ID NO: 6582 - protein, 251 aa, Artificial Sequence
  Synthetic Polypeptide
MDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSKDEL

SEQ ID NO: 6583 - protein, 254 aa, Artificial Sequence
  Synthetic Polypeptide
MDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSKDEL

SEQ ID NO: 6584 - protein, 252 aa, Artificial Sequence
  Synthetic Polypeptide
MDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSKDEL

SEQ ID NO: 6585 - protein, 253 aa, Artificial Sequence
  Synthetic Polypeptide
MDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSKDEL

SEQ ID NO: 6586 - protein, 249 aa, Artificial Sequence
  Synthetic Polypeptide
MDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSKDEL

SEQ ID NO: 6587 - protein, 251 aa, Artificial Sequence
  Synthetic Polypeptide
MSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKKDEL

SEQ ID NO: 6588 - protein, 246 aa, Artificial Sequence
  Synthetic Polypeptide
MQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAKDEL

SEQ ID NO: 6589 - protein, 247 aa, Artificial Sequence
  Synthetic Polypeptide
MDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSKDEL

SEQ ID NO: 6590 - skipped

SEQ ID NO: 6591 - protein, 249 aa, Artificial Sequence
  Synthetic Polypeptide
MDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSHHHHHH

SEQ ID NO: 6592 - protein, 249 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSHHHHHH

SEQ ID NO: 6593 - protein, 249 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSHHHHHH

SEQ ID NO: 6594 - protein, 250 aa, Artificial Sequence
  Synthetic Polypeptide
MDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSHHHHHH

SEQ ID NO: 6595 - protein, 257 aa, Artificial Sequence
  Synthetic Polypeptide
MDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSHHHHHH

SEQ ID NO: 6596 - protein, 274 aa, Artificial Sequence
  Synthetic Polypeptide
MINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSHHHHHH

SEQ ID NO: 6597 - protein, 251 aa, Artificial Sequence
  Synthetic Polypeptide
MDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSHHHHHH

SEQ ID NO: 6598 - protein, 250 aa, Artificial Sequence
  Synthetic Polypeptide
MQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSHHHHHH

SEQ ID NO: 6599 - protein, 256 aa, Artificial Sequence
  Synthetic Polypeptide
MQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSHHHHHH

SEQ ID NO: 6600 - protein, 261 aa, Artificial Sequence
  Synthetic Polypeptide
MQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSHHHHHH

SEQ ID NO: 6601 - protein, 248 aa, Artificial Sequence
  Synthetic Polypeptide
MDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAHHHHHH

SEQ ID NO: 6602 - protein, 258 aa, Artificial Sequence
  Synthetic Polypeptide
MDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSHHHHHH

SEQ ID NO: 6603 - protein, 249 aa, Artificial Sequence
  Synthetic Polypeptide
MDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSHHHHHH

SEQ ID NO: 6604 - protein, 253 aa, Artificial Sequence
  Synthetic Polypeptide
MDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSHHHHHH

SEQ ID NO: 6605 - protein, 251 aa, Artificial Sequence
  Synthetic Polypeptide
MDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSHHHHHH

SEQ ID NO: 6606 - protein, 251 aa, Artificial Sequence
  Synthetic Polypeptide
MDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSHHHHHH

SEQ ID NO: 6607 - protein, 252 aa, Artificial Sequence
  Synthetic Polypeptide
MQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSHHHHHH

SEQ ID NO: 6608 - protein, 250 aa, Artificial Sequence
  Synthetic Polypeptide
MQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSHHHHHH

SEQ ID NO: 6609 - protein, 261 aa, Artificial Sequence
  Synthetic Polypeptide
MLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSHHHHHH

SEQ ID NO: 6610 - protein, 250 aa, Artificial Sequence
  Synthetic Polypeptide
MDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSHHHHHH

SEQ ID NO: 6611 - protein, 251 aa, Artificial Sequence
  Synthetic Polypeptide
MDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSHHHHHH

SEQ ID NO: 6612 - protein, 252 aa, Artificial Sequence
  Synthetic Polypeptide
MDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSHHHHHH

SEQ ID NO: 6613 - protein, 252 aa, Artificial Sequence
  Synthetic Polypeptide
MDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSHHHHHH

SEQ ID NO: 6614 - protein, 252 aa, Artificial Sequence; identical to SEQ ID NO: 6613
  Synthetic Polypeptide

SEQ ID NO: 6615 - protein, 252 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSHHHHHH

SEQ ID NO: 6616 - protein, 254 aa, Artificial Sequence
  Synthetic Polypeptide
MDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSHHHHHH

SEQ ID NO: 6617 - protein, 251 aa, Artificial Sequence
  Synthetic Polypeptide
MDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSHHHHHH

SEQ ID NO: 6618 - protein, 254 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSHHHHHH

SEQ ID NO: 6619 - protein, 252 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSHHHHHH

SEQ ID NO: 6620 - protein, 251 aa, Artificial Sequence
  Synthetic Polypeptide
MDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSHHHHHH

SEQ ID NO: 6621 - protein, 261 aa, Artificial Sequence
  Synthetic Polypeptide
MSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTHHHHHH

SEQ ID NO: 6622 - protein, 253 aa, Artificial Sequence
  Synthetic Polypeptide
MQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASHHHHHH

SEQ ID NO: 6623 - protein, 251 aa, Artificial Sequence; identical to SEQ ID NO: 6620
  Synthetic Polypeptide

SEQ ID NO: 6624 - protein, 250 aa, Artificial Sequence
  Synthetic Polypeptide
MEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSHHHHHH

SEQ ID NO: 6625 - protein, 252 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSHHHHHH

SEQ ID NO: 6626 - protein, 250 aa, Artificial Sequence
  Synthetic Polypeptide
MEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSHHHHHH

SEQ ID NO: 6627 - protein, 255 aa, Artificial Sequence
  Synthetic Polypeptide
MDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSHHHHHH

SEQ ID NO: 6628 - protein, 247 aa, Artificial Sequence
  Synthetic Polypeptide
MDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSHHHHHH

SEQ ID NO: 6629 - protein, 253 aa, Artificial Sequence
  Synthetic Polypeptide
MDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSHHHHHH

SEQ ID NO: 6630 - protein, 253 aa, Artificial Sequence
  Synthetic Polypeptide
MQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKHHHHHH

SEQ ID NO: 6631 - protein, 246 aa, Artificial Sequence
  Synthetic Polypeptide
MDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSHHHHHH

SEQ ID NO: 6632 - protein, 251 aa, Artificial Sequence
  Synthetic Polypeptide
MDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSHHHHHH

SEQ ID NO: 6633 - protein, 248 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSHHHHHH

SEQ ID NO: 6634 - protein, 258 aa, Artificial Sequence
  Synthetic Polypeptide
MDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSHHHHHH

SEQ ID NO: 6635 - protein, 254 aa, Artificial Sequence
  Synthetic Polypeptide
MDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSHHHHHH

SEQ ID NO: 6636 - protein, 280 aa, Artificial Sequence
  Synthetic Polypeptide
MYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASHHHHHH

SEQ ID NO: 6637 - protein, 279 aa, Artificial Sequence
  Synthetic Polypeptide
MYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERHHHHHH

SEQ ID NO: 6638 - protein, 295 aa, Artificial Sequence
  Synthetic Polypeptide
MDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDIHHHHHH

SEQ ID NO: 6639 - protein, 251 aa, Artificial Sequence
  Synthetic Polypeptide
MEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSHHHHHH

SEQ ID NO: 6640 - protein, 250 aa, Artificial Sequence
  Synthetic Polypeptide
MDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSHHHHHH

SEQ ID NO: 6641 - protein, 247 aa, Artificial Sequence
  Synthetic Polypeptide
MDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSHHHHHH

SEQ ID NO: 6642 - protein, 257 aa, Artificial Sequence
  Synthetic Polypeptide
MDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSHHHHHH

SEQ ID NO: 6643 - protein, 244 aa, Artificial Sequence
  Synthetic Polypeptide
MDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSHHHHHH

SEQ ID NO: 6644 - protein, 252 aa, Artificial Sequence
  Synthetic Polypeptide
MDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSHHHHHH

SEQ ID NO: 6645 - protein, 248 aa, Artificial Sequence
  Synthetic Polypeptide
MDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSHHHHHH

SEQ ID NO: 6646 - protein, 252 aa, Artificial Sequence
  Synthetic Polypeptide
MDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSHHHHHH

SEQ ID NO: 6647 - protein, 248 aa, Artificial Sequence
  Synthetic Polypeptide
MDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSHHHHHH

SEQ ID NO: 6648 - protein, 256 aa, Artificial Sequence
  Synthetic Polypeptide
MDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSHHHHHH

SEQ ID NO: 6649 - protein, 251 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSHHHHHH

SEQ ID NO: 6650 - protein, 255 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSHHHHHH

SEQ ID NO: 6651 - protein, 255 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSHHHHHH

SEQ ID NO: 6652 - protein, 249 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSHHHHHH

SEQ ID NO: 6653 - protein, 251 aa, Artificial Sequence
  Synthetic Polypeptide
MQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSHHHHHH

SEQ ID NO: 6654 - protein, 248 aa, Artificial Sequence
  Synthetic Polypeptide
MDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSHHHHHH

SEQ ID NO: 6655 - protein, 249 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSHHHHHH

SEQ ID NO: 6656 - protein, 245 aa, Artificial Sequence
  Synthetic Polypeptide
MDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSHHHHHH

SEQ ID NO: 6657 - protein, 276 aa, Artificial Sequence
  Synthetic Polypeptide
MYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSHHHHHH

SEQ ID NO: 6658 - protein, 247 aa, Artificial Sequence
  Synthetic Polypeptide
MEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSHHHHHH

SEQ ID NO: 6659 - protein, 256 aa, Artificial Sequence
  Synthetic Polypeptide
MDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSHHHHHH

SEQ ID NO: 6660 - protein, 260 aa, Artificial Sequence
  Synthetic Polypeptide
MDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSHHHHHH

SEQ ID NO: 6661 - protein, 251 aa, Artificial Sequence
  Synthetic Polypeptide
MDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSHHHHHH

SEQ ID NO: 6662 - protein, 246 aa, Artificial Sequence
  Synthetic Polypeptide
MDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSHHHHHH

SEQ ID NO: 6663 - protein, 249 aa, Artificial Sequence
  Synthetic Polypeptide
MEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSHHHHHH

SEQ ID NO: 6664 - protein, 244 aa, Artificial Sequence
  Synthetic Polypeptide
MQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSAHHHHHH

SEQ ID NO: 6665 - protein, 254 aa, Artificial Sequence
  Synthetic Polypeptide
MDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSHHHHHH

SEQ ID NO: 6666 - protein, 246 aa, Artificial Sequence
  Synthetic Polypeptide
MDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSHHHHHH

SEQ ID NO: 6667 - protein, 249 aa, Artificial Sequence
  Synthetic Polypeptide
MDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSHHHHHH

SEQ ID NO: 6668 - protein, 259 aa, Artificial Sequence
  Synthetic Polypeptide
MDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSHHHHHH

SEQ ID NO: 6669 - protein, 256 aa, Artificial Sequence
  Synthetic Polypeptide
MEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSHHHHHH

SEQ ID NO: 6670 - protein, 248 aa, Artificial Sequence
  Synthetic Polypeptide
MDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAHHHHHH

SEQ ID NO: 6671 - protein, 241 aa, Artificial Sequence
  Synthetic Polypeptide
MMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSHHHHHH

SEQ ID NO: 6672 - protein, 246 aa, Artificial Sequence
  Synthetic Polypeptide
MQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSHHHHHH

SEQ ID NO: 6673 - protein, 249 aa, Artificial Sequence
  Synthetic Polypeptide
MDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSHHHHHH

SEQ ID NO: 6674 - protein, 254 aa, Artificial Sequence
  Synthetic Polypeptide
MDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSHHHHHH

SEQ ID NO: 6675 - protein, 249 aa, Artificial Sequence
  Synthetic Polypeptide
MDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSHHHHHH

SEQ ID NO: 6676 - protein, 255 aa, Artificial Sequence
  Synthetic Polypeptide
MDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSHHHHHH

SEQ ID NO: 6677 - protein, 253 aa, Artificial Sequence
  Synthetic Polypeptide
MEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSHHHHHH

SEQ ID NO: 6678 - protein, 253 aa, Artificial Sequence
  Synthetic Polypeptide
MEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSHHHHHH

SEQ ID NO: 6679 - protein, 251 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSHHHHHH

SEQ ID NO: 6680 - protein, 248 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSHHHHHH

SEQ ID NO: 6681 - protein, 249 aa, Artificial Sequence
  Synthetic Polypeptide
MDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSHHHHHH

SEQ ID NO: 6682 - protein, 251 aa, Artificial Sequence
  Synthetic Polypeptide
MDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSHHHHHH

SEQ ID NO: 6683 - protein, 252 aa, Artificial Sequence
  Synthetic Polypeptide
MDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSHHHHHH

SEQ ID NO: 6684 - protein, 252 aa, Artificial Sequence
  Synthetic Polypeptide
MDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSHHHHHH

SEQ ID NO: 6685 - protein, 252 aa, Artificial Sequence
  Synthetic Polypeptide
MDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSHHHHHH

SEQ ID NO: 6686 - protein, 250 aa, Artificial Sequence
  Synthetic Polypeptide
MDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAHHHHHH

SEQ ID NO: 6687 - protein, 250 aa, Artificial Sequence
  Synthetic Polypeptide
MDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSHHHHHH

SEQ ID NO: 6688 - protein, 255 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSHHHHHH

SEQ ID NO: 6689 - protein, 255 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSHHHHHH

SEQ ID NO: 6690 - protein, 253 aa, Artificial Sequence
  Synthetic Polypeptide
MDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSHHHHHH

SEQ ID NO: 6691 - protein, 248 aa, Artificial Sequence
  Synthetic Polypeptide
MEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSHHHHHH

SEQ ID NO: 6692 - protein, 243 aa, Artificial Sequence
  Synthetic Polypeptide
MDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSHHHHHH

SEQ ID NO: 6693 - protein, 249 aa, Artificial Sequence
  Synthetic Polypeptide
MDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKHHHHHH

SEQ ID NO: 6694 - protein, 256 aa, Artificial Sequence
  Synthetic Polypeptide
MDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSHHHHHH

SEQ ID NO: 6695 - protein, 257 aa, Artificial Sequence
  Synthetic Polypeptide
MDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSHHHHHH

SEQ ID NO: 6696 - protein, 254 aa, Artificial Sequence
  Synthetic Polypeptide
MDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSHHHHHH

SEQ ID NO: 6697 - protein, 251 aa, Artificial Sequence
  Synthetic Polypeptide
MDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSHHHHHH

SEQ ID NO: 6698 - protein, 262 aa, Artificial Sequence
  Synthetic Polypeptide
MDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTHHHHHH

SEQ ID NO: 6699 - protein, 258 aa, Artificial Sequence
  Synthetic Polypeptide
MQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGHHHHHH

SEQ ID NO: 6700 - protein, 252 aa, Artificial Sequence
  Synthetic Polypeptide
MDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSHHHHHH

SEQ ID NO: 6701 - protein, 249 aa, Artificial Sequence
  Synthetic Polypeptide
MDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSHHHHHH

SEQ ID NO: 6702 - protein, 247 aa, Artificial Sequence
  Synthetic Polypeptide
MDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSHHHHHH

SEQ ID NO: 6703 - protein, 249 aa, Artificial Sequence
  Synthetic Polypeptide
MDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSHHHHHH

SEQ ID NO: 6704 - protein, 251 aa, Artificial Sequence
  Synthetic Polypeptide
MQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSHHHHHH

SEQ ID NO: 6705 - protein, 256 aa, Artificial Sequence
  Synthetic Polypeptide
MQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSHHHHHH

SEQ ID NO: 6706 - protein, 250 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSHHHHHH

SEQ ID NO: 6707 - protein, 251 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSHHHHHH

SEQ ID NO: 6708 - protein, 250 aa, Artificial Sequence
  Synthetic Polypeptide
MQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSHHHHHH

SEQ ID NO: 6709 - protein, 249 aa, Artificial Sequence
  Synthetic Polypeptide
MQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVHHHHHH

SEQ ID NO: 6710 - protein, 249 aa, Artificial Sequence
  Synthetic Polypeptide
MQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSHHHHHH

SEQ ID NO: 6711 - protein, 251 aa, Artificial Sequence
  Synthetic Polypeptide
MQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSHHHHHH

SEQ ID NO: 6712 - protein, 249 aa, Artificial Sequence
  Synthetic Polypeptide
MDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSAHHHHHH

SEQ ID NO: 6713 - protein, 248 aa, Artificial Sequence
  Synthetic Polypeptide
MDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSHHHHHH

SEQ ID NO: 6714 - protein, 248 aa, Artificial Sequence
  Synthetic Polypeptide
MDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSHHHHHH

SEQ ID NO: 6715 - protein, 256 aa, Artificial Sequence
  Synthetic Polypeptide
MDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPHHHHHH

SEQ ID NO: 6716 - protein, 262 aa, Artificial Sequence
  Synthetic Polypeptide
MQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSHHHHHH

SEQ ID NO: 6717 - protein, 247 aa, Artificial Sequence
  Synthetic Polypeptide
MEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSHHHHHH

SEQ ID NO: 6718 - protein, 257 aa, Artificial Sequence
  Synthetic Polypeptide
MELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSHHHHHH

SEQ ID NO: 6719 - protein, 253 aa, Artificial Sequence
  Synthetic Polypeptide
MDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSHHHHHH

SEQ ID NO: 6720 - protein, 237 aa, Artificial Sequence
  Synthetic Polypeptide
MDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSHHHHHH

SEQ ID NO: 6721 - protein, 247 aa, Artificial Sequence
  Synthetic Polypeptide
MDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSHHHHHH

SEQ ID NO: 6722 - protein, 251 aa, Artificial Sequence
  Synthetic Polypeptide
MDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSHHHHHH

SEQ ID NO: 6723 - protein, 247 aa, Artificial Sequence
  Synthetic Polypeptide
MDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSHHHHHH

SEQ ID NO: 6724 - protein, 248 aa, Artificial Sequence
  Synthetic Polypeptide
MDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSHHHHHH

SEQ ID NO: 6725 - protein, 253 aa, Artificial Sequence
  Synthetic Polypeptide
MDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSHHHHHH

SEQ ID NO: 6726 - protein, 247 aa, Artificial Sequence
  Synthetic Polypeptide
MDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSHHHHHH

SEQ ID NO: 6727 - protein, 248 aa, Artificial Sequence
  Synthetic Polypeptide
MDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAAHHHHHH

SEQ ID NO: 6728 - protein, 256 aa, Artificial Sequence
  Synthetic Polypeptide
MDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASHHHHHH

SEQ ID NO: 6729 - protein, 252 aa, Artificial Sequence; identical to SEQ ID NO: 6646
  Synthetic Polypeptide

SEQ ID NO: 6730 - protein, 249 aa, Artificial Sequence
  Synthetic Polypeptide
MDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSHHHHHH

SEQ ID NO: 6731 - protein, 249 aa, Artificial Sequence
  Synthetic Polypeptide
MDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSHHHHHH

SEQ ID NO: 6732 - protein, 248 aa, Artificial Sequence
  Synthetic Polypeptide
MDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSHHHHHH

SEQ ID NO: 6733 - protein, 247 aa, Artificial Sequence
  Synthetic Polypeptide
MDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINHHHHHH

SEQ ID NO: 6734 - protein, 248 aa, Artificial Sequence
  Synthetic Polypeptide
MDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSHHHHHH

SEQ ID NO: 6735 - protein, 252 aa, Artificial Sequence
  Synthetic Polypeptide
MDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSHHHHHH

SEQ ID NO: 6736 - protein, 255 aa, Artificial Sequence
  Synthetic Polypeptide
MDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSHHHHHH

SEQ ID NO: 6737 - protein, 257 aa, Artificial Sequence
  Synthetic Polypeptide
MDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSHHHHHH

SEQ ID NO: 6738 - protein, 256 aa, Artificial Sequence
  Synthetic Polypeptide
MDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSHHHHHH

SEQ ID NO: 6739 - protein, 246 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSHHHHHH

SEQ ID NO: 6740 - protein, 248 aa, Artificial Sequence
  Synthetic Polypeptide
MDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSHHHHHH

SEQ ID NO: 6741 - protein, 248 aa, Artificial Sequence
  Synthetic Polypeptide
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSHHHHHH

SEQ ID NO: 6742 - protein, 249 aa, Artificial Sequence
  Synthetic Polypeptide
MAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSHHHHHH

SEQ ID NO: 6743 - protein, 247 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSHHHHHH

SEQ ID NO: 6744 - protein, 266 aa, Artificial Sequence
  Synthetic Polypeptide
MDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSHHHHHH

SEQ ID NO: 6745 - protein, 263 aa, Artificial Sequence
  Synthetic Polypeptide
MDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSHHHHHH

SEQ ID NO: 6746 - protein, 237 aa, Artificial Sequence
  Synthetic Polypeptide
MDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSHHHHHH

SEQ ID NO: 6747 - protein, 253 aa, Artificial Sequence
  Synthetic Polypeptide
MDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSHHHHHH

SEQ ID NO: 6748 - protein, 244 aa, Artificial Sequence
  Synthetic Polypeptide
MDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSHHHHHH

SEQ ID NO: 6749 - protein, 245 aa, Artificial Sequence
  Synthetic Polypeptide
MDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSHHHHHH

SEQ ID NO: 6750 - protein, 245 aa, Artificial Sequence
  Synthetic Polypeptide
MDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSAHHHHHH

SEQ ID NO: 6751 - protein, 256 aa, Artificial Sequence
  Synthetic Polypeptide
MEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSHHHHHH

SEQ ID NO: 6752 - protein, 252 aa, Artificial Sequence
  Synthetic Polypeptide
MQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSHHHHHH

SEQ ID NO: 6753 - protein, 247 aa, Artificial Sequence
  Synthetic Polypeptide
MENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSHHHHHH

SEQ ID NO: 6754 - protein, 251 aa, Artificial Sequence
  Synthetic Polypeptide
MDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSHHHHHH

SEQ ID NO: 6755 - protein, 260 aa, Artificial Sequence
  Synthetic Polypeptide
MDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSHHHHHH

SEQ ID NO: 6756 - protein, 251 aa, Artificial Sequence
  Synthetic Polypeptide
MDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSHHHHHH

SEQ ID NO: 6757 - protein, 254 aa, Artificial Sequence
  Synthetic Polypeptide
MDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSHHHHHH

SEQ ID NO: 6758 - protein, 249 aa, Artificial Sequence
  Synthetic Polypeptide
MDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSAHHHHHH

SEQ ID NO: 6759 - protein, 250 aa, Artificial Sequence
  Synthetic Polypeptide
MEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSHHHHHH

SEQ ID NO: 6760 - protein, 247 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSHHHHHH

SEQ ID NO: 6761 - protein, 259 aa, Artificial Sequence
  Synthetic Polypeptide
MDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSHHHHHH

SEQ ID NO: 6762 - protein, 249 aa, Artificial Sequence
  Synthetic Polypeptide
MEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSHHHHHH

SEQ ID NO: 6763 - protein, 246 aa, Artificial Sequence
  Synthetic Polypeptide
MDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSHHHHHH

SEQ ID NO: 6764 - protein, 251 aa, Artificial Sequence
  Synthetic Polypeptide
MDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSHHHHHH

SEQ ID NO: 6765 - protein, 250 aa, Artificial Sequence
  Synthetic Polypeptide
MDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSHHHHHH

SEQ ID NO: 6766 - protein, 252 aa, Artificial Sequence
  Synthetic Polypeptide
MDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSHHHHHH

SEQ ID NO: 6767 - protein, 248 aa, Artificial Sequence
  Synthetic Polypeptide
MQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSHHHHHH

SEQ ID NO: 6768 - protein, 246 aa, Artificial Sequence
  Synthetic Polypeptide
MDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSHHHHHH

SEQ ID NO: 6769 - protein, 257 aa, Artificial Sequence
  Synthetic Polypeptide
MAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSHHHHHH

SEQ ID NO: 6770 - protein, 252 aa, Artificial Sequence
  Synthetic Polypeptide
MDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSHHHHHH

SEQ ID NO: 6771 - protein, 253 aa, Artificial Sequence
  Synthetic Polypeptide
MDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSHHHHHH

SEQ ID NO: 6772 - protein, 253 aa, Artificial Sequence
  Synthetic Polypeptide
MDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSHHHHHH

SEQ ID NO: 6773 - protein, 253 aa, Artificial Sequence
  Synthetic Polypeptide
MQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSHHHHHH

SEQ ID NO: 6774 - protein, 247 aa, Artificial Sequence
  Synthetic Polypeptide
MDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSHHHHHH

SEQ ID NO: 6775 - protein, 249 aa, Artificial Sequence
  Synthetic Polypeptide
MEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSHHHHHH

SEQ ID NO: 6776 - protein, 248 aa, Artificial Sequence
  Synthetic Polypeptide
MELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSHHHHHH

SEQ ID NO: 6777 - protein, 250 aa, Artificial Sequence
  Synthetic Polypeptide
MDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSHHHHHH

SEQ ID NO: 6778 - protein, 241 aa, Artificial Sequence
  Synthetic Polypeptide
MDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSHHHHHH

SEQ ID NO: 6779 - protein, 244 aa, Artificial Sequence
  Synthetic Polypeptide
MDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSHHHHHH

SEQ ID NO: 6780 - protein, 251 aa, Artificial Sequence
  Synthetic Polypeptide
MDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSHHHHHH

SEQ ID NO: 6781 - protein, 247 aa, Artificial Sequence
  Synthetic Polypeptide
MDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSHHHHHH

SEQ ID NO: 6782 - protein, 248 aa, Artificial Sequence
  Synthetic Polypeptide
MEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSHHHHHH

SEQ ID NO: 6783 - protein, 249 aa, Artificial Sequence
  Synthetic Polypeptide
MEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSHHHHHH

SEQ ID NO: 6784 - protein, 254 aa, Artificial Sequence
  Synthetic Polypeptide
MDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSHHHHHH

SEQ ID NO: 6785 - protein, 261 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSHHHHHHEQKLISEEDL

SEQ ID NO: 6786 - protein, 255 aa, Artificial Sequence
  Synthetic Polypeptide
MEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSHHHHHHEQKLISEEDL

SEQ ID NO: 6787 - protein, 260 aa, Artificial Sequence
  Synthetic Polypeptide
MDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSHHHHHHEQKLISEEDL

SEQ ID NO: 6788 - protein, 257 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSHHHHHHEQKLISEEDL

SEQ ID NO: 6789 - protein, 262 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSHHHHHHEQKLISEEDL

SEQ ID NO: 6790 - protein, 267 aa, Artificial Sequence
  Synthetic Polypeptide
MDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSHHHHHHEQKLISEEDL

SEQ ID NO: 6791 - protein, 272 aa, Artificial Sequence
  Synthetic Polypeptide
MDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSHHHHHHEQKLISEEDL

SEQ ID NO: 6792 - protein, 263 aa, Artificial Sequence
  Synthetic Polypeptide
MEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSHHHHHHEQKLISEEDL

SEQ ID NO: 6793 - protein, 259 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSHHHHHHEQKLISEEDL

SEQ ID NO: 6794 - protein, 264 aa, Artificial Sequence
  Synthetic Polypeptide
MDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSHHHHHHEQKLISEEDL

SEQ ID NO: 6795 - protein, 254 aa, Artificial Sequence
  Synthetic Polypeptide
MDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSHHHHHHEQKLISEEDL

SEQ ID NO: 6796 - protein, 254 aa, Artificial Sequence
  Synthetic Polypeptide
MEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSHHHHHHEQKLISEEDL

SEQ ID NO: 6797 - protein, 258 aa, Artificial Sequence
  Synthetic Polypeptide
MEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSHHHHHHEQKLISEEDL

SEQ ID NO: 6798 - protein, 262 aa, Artificial Sequence
  Synthetic Polypeptide
MDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAHHHHHHEQKLISEEDL

SEQ ID NO: 6799 - protein, 262 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSHHHHHHEQKLISEEDL

SEQ ID NO: 6800 - protein, 264 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSHHHHHHEQKLISEEDL

SEQ ID NO: 6801 - protein, 264 aa, Artificial Sequence
  Synthetic Polypeptide
MDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSHHHHHHEQKLISEEDL

SEQ ID NO: 6802 - protein, 261 aa, Artificial Sequence
  Synthetic Polypeptide
MEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSHHHHHHEQKLISEEDL

SEQ ID NO: 6803 - protein, 261 aa, Artificial Sequence
  Synthetic Polypeptide
MQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRHHHHHHEQKLISEEDL

SEQ ID NO: 6804 - protein, 267 aa, Artificial Sequence
  Synthetic Polypeptide
MDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSHHHHHHEQKLISEEDL

SEQ ID NO: 6805 - protein, 267 aa, Artificial Sequence
  Synthetic Polypeptide
MQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRHHHHHHEQKLISEEDL

SEQ ID NO: 6806 - protein, 257 aa, Artificial Sequence
  Synthetic Polypeptide
MDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSHHHHHHEQKLISEEDL

SEQ ID NO: 6807 - protein, 257 aa, Artificial Sequence
  Synthetic Polypeptide
MQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKHHHHHHEQKLISEEDL

SEQ ID NO: 6808 - protein, 246 aa, Artificial Sequence
  Synthetic Polypeptide
MEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQSPSPSSRAETDLGRGSV

SEQ ID NO: 6809 - protein, 246 aa, Artificial Sequence; identical to SEQ ID NO: 6808
  Synthetic Polypeptide

SEQ ID NO: 6810 - protein, 249 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQSPSPSSRAETDLGRGSV

SEQ ID NO: 6811 - protein, 249 aa, Artificial Sequence; identical to SEQ ID NO: 6810
  Synthetic Polypeptide

SEQ ID NO: 6812 - protein, 262 aa, Artificial Sequence
  Synthetic Polypeptide
MDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSHHHHHHEQKLISEEDL

SEQ ID NO: 6813 - protein, 262 aa, Artificial Sequence
  Synthetic Polypeptide
MQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRHHHHHHEQKLISEEDL

SEQ ID NO: 6814 - protein, 265 aa, Artificial Sequence
  Synthetic Polypeptide
MQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSHHHHHHEQKLISEEDL

SEQ ID NO: 6815 - protein, 265 aa, Artificial Sequence
  Synthetic Polypeptide
MQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQHHHHHHEQKLISEEDL

SEQ ID NO: 6816 - protein, 257 aa, Artificial Sequence
  Synthetic Polypeptide
MDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSHHHHHHEQKLISEEDL

SEQ ID NO: 6817 - protein, 257 aa, Artificial Sequence
  Synthetic Polypeptide
MQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRHHHHHHEQKLISEEDL

SEQ ID NO: 6818 - protein, 265 aa, Artificial Sequence
  Synthetic Polypeptide
MDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSHHHHHHEQKLISEEDL

SEQ ID NO: 6819 - protein, 265 aa, Artificial Sequence
  Synthetic Polypeptide
MQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRHHHHHHEQKLISEEDL

SEQ ID NO: 6820 - protein, 260 aa, Artificial Sequence
  Synthetic Polypeptide
MDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSHHHHHHEQKLISEEDL

SEQ ID NO: 6821 - protein, 260 aa, Artificial Sequence
  Synthetic Polypeptide
MEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRHHHHHHEQKLISEEDL

SEQ ID NO: 6822 - protein, 257 aa, Artificial Sequence
  Synthetic Polypeptide
MDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSHHHHHHEQKLISEEDL

SEQ ID NO: 6823 - protein, 257 aa, Artificial Sequence
  Synthetic Polypeptide
MEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRHHHHHHEQKLISEEDL

SEQ ID NO: 6824 - protein, 257 aa, Artificial Sequence
  Synthetic Polypeptide
MDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSHHHHHHEQKLISEEDL

SEQ ID NO: 6825 - protein, 257 aa, Artificial Sequence
  Synthetic Polypeptide
MEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVHHHHHHEQKLISEEDL

SEQ ID NO: 6826 - protein, 265 aa, Artificial Sequence
  Synthetic Polypeptide
MQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSHHHHHHEQKLISEEDL

SEQ ID NO: 6827 - protein, 265 aa, Artificial Sequence
  Synthetic Polypeptide
MQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGHHHHHHEQKLISEEDL

SEQ ID NO: 6828 - protein, 272 aa, Artificial Sequence
  Synthetic Polypeptide
MDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSHHHHHHEQKLISEEDL

SEQ ID NO: 6829 - protein, 272 aa, Artificial Sequence
  Synthetic Polypeptide
MEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVHHHHHHEQKLISEEDL

SEQ ID NO: 6830 - protein, 245 aa, Artificial Sequence
  Synthetic Polypeptide
MVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSHHHHHH

SEQ ID NO: 6831 - protein, 248 aa, Artificial Sequence
  Synthetic Polypeptide
MEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSHHHHHH

SEQ ID NO: 6832 - protein, 253 aa, Artificial Sequence
  Synthetic Polypeptide
MDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSHHHHHH

SEQ ID NO: 6833 - protein, 256 aa, Artificial Sequence
  Synthetic Polypeptide
MDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSHHHHHH

SEQ ID NO: 6834 - protein, 254 aa, Artificial Sequence
  Synthetic Polypeptide
MDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSHHHHHH

SEQ ID NO: 6835 - protein, 255 aa, Artificial Sequence
  Synthetic Polypeptide
MDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSHHHHHH

SEQ ID NO: 6836 - protein, 251 aa, Artificial Sequence
  Synthetic Polypeptide
MDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSHHHHHH

SEQ ID NO: 6837 - protein, 253 aa, Artificial Sequence
  Synthetic Polypeptide
MSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKHHHHHH

SEQ ID NO: 6838 - protein, 248 aa, Artificial Sequence
  Synthetic Polypeptide
MQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAHHHHHH

SEQ ID NO: 6839 - protein, 249 aa, Artificial Sequence
  Synthetic Polypeptide
MDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSHHHHHH

SEQ ID NO: 6840 - skipped

SEQ ID NO: 6841 - protein, 356 aa, Artificial Sequence
  Synthetic Polypeptide
MDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6842 - protein, 356 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6843 - protein, 356 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6844 - protein, 357 aa, Artificial Sequence
  Synthetic Polypeptide
MDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6845 - protein, 364 aa, Artificial Sequence
  Synthetic Polypeptide
MDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6846 - protein, 381 aa, Artificial Sequence
  Synthetic Polypeptide
MINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6847 - protein, 358 aa, Artificial Sequence
  Synthetic Polypeptide
MDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6848 - protein, 357 aa, Artificial Sequence
  Synthetic Polypeptide
MQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6849 - protein, 363 aa, Artificial Sequence
  Synthetic Polypeptide
MQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6850 - protein, 368 aa, Artificial Sequence
  Synthetic Polypeptide
MQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6851 - protein, 355 aa, Artificial Sequence
  Synthetic Polypeptide
MDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6852 - protein, 365 aa, Artificial Sequence
  Synthetic Polypeptide
MDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6853 - protein, 356 aa, Artificial Sequence
  Synthetic Polypeptide
MDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6854 - protein, 360 aa, Artificial Sequence
  Synthetic Polypeptide
MDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6855 - protein, 358 aa, Artificial Sequence
  Synthetic Polypeptide
MDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6856 - protein, 358 aa, Artificial Sequence
  Synthetic Polypeptide
MDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6857 - protein, 359 aa, Artificial Sequence
  Synthetic Polypeptide
MQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6858 - protein, 357 aa, Artificial Sequence
  Synthetic Polypeptide
MQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6859 - protein, 368 aa, Artificial Sequence
  Synthetic Polypeptide
MLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6860 - protein, 357 aa, Artificial Sequence
  Synthetic Polypeptide
MDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6861 - protein, 358 aa, Artificial Sequence
  Synthetic Polypeptide
MDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6862 - protein, 359 aa, Artificial Sequence
  Synthetic Polypeptide
MDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6863 - protein, 359 aa, Artificial Sequence
  Synthetic Polypeptide
MDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6864 - protein, 359 aa, Artificial Sequence; identical to SEQ ID NO: 6863
  Synthetic Polypeptide

SEQ ID NO: 6865 - protein, 359 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6866 - protein, 361 aa, Artificial Sequence
  Synthetic Polypeptide
MDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6867 - protein, 358 aa, Artificial Sequence
  Synthetic Polypeptide
MDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6868 - protein, 361 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6869 - protein, 359 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6870 - protein, 358 aa, Artificial Sequence
  Synthetic Polypeptide
MDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6871 - protein, 368 aa, Artificial Sequence
  Synthetic Polypeptide
MSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6872 - protein, 360 aa, Artificial Sequence
  Synthetic Polypeptide
MQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6873 - protein, 358 aa, Artificial Sequence; identical to SEQ ID NO: 6870
  Synthetic Polypeptide

SEQ ID NO: 6874 - protein, 357 aa, Artificial Sequence
  Synthetic Polypeptide
MEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6875 - protein, 359 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6876 - protein, 357 aa, Artificial Sequence
  Synthetic Polypeptide
MEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6877 - protein, 362 aa, Artificial Sequence
  Synthetic Polypeptide
MDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6878 - protein, 354 aa, Artificial Sequence
  Synthetic Polypeptide
MDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6879 - protein, 360 aa, Artificial Sequence
  Synthetic Polypeptide
MDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6880 - protein, 360 aa, Artificial Sequence
  Synthetic Polypeptide
MQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6881 - protein, 353 aa, Artificial Sequence
  Synthetic Polypeptide
MDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6882 - protein, 358 aa, Artificial Sequence
  Synthetic Polypeptide
MDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6883 - protein, 355 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6884 - protein, 365 aa, Artificial Sequence
  Synthetic Polypeptide
MDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6885 - protein, 361 aa, Artificial Sequence
  Synthetic Polypeptide
MDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6886 - protein, 387 aa, Artificial Sequence
  Synthetic Polypeptide
MYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6887 - protein, 386 aa, Artificial Sequence
  Synthetic Polypeptide
MYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6888 - protein, 402 aa, Artificial Sequence
  Synthetic Polypeptide
MDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDIGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6889 - protein, 358 aa, Artificial Sequence
  Synthetic Polypeptide
MEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6890 - protein, 357 aa, Artificial Sequence
  Synthetic Polypeptide
MDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6891 - protein, 354 aa, Artificial Sequence
  Synthetic Polypeptide
MDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6892 - protein, 364 aa, Artificial Sequence
  Synthetic Polypeptide
MDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6893 - protein, 351 aa, Artificial Sequence
  Synthetic Polypeptide
MDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6894 - protein, 359 aa, Artificial Sequence
  Synthetic Polypeptide
MDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6895 - protein, 355 aa, Artificial Sequence
  Synthetic Polypeptide
MDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6896 - protein, 359 aa, Artificial Sequence
  Synthetic Polypeptide
MDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6897 - protein, 355 aa, Artificial Sequence
  Synthetic Polypeptide
MDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6898 - protein, 363 aa, Artificial Sequence
  Synthetic Polypeptide
MDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6899 - protein, 358 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6900 - protein, 362 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6901 - protein, 362 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6902 - protein, 356 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6903 - protein, 358 aa, Artificial Sequence
  Synthetic Polypeptide
MQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6904 - protein, 355 aa, Artificial Sequence
  Synthetic Polypeptide
MDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6905 - protein, 356 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6906 - protein, 352 aa, Artificial Sequence
  Synthetic Polypeptide
MDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6907 - protein, 383 aa, Artificial Sequence
  Synthetic Polypeptide
MYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6908 - protein, 354 aa, Artificial Sequence
  Synthetic Polypeptide
MEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6909 - protein, 363 aa, Artificial Sequence
  Synthetic Polypeptide
MDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6910 - protein, 367 aa, Artificial Sequence
  Synthetic Polypeptide
MDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6911 - protein, 358 aa, Artificial Sequence
  Synthetic Polypeptide
MDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6912 - protein, 353 aa, Artificial Sequence
  Synthetic Polypeptide
MDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6913 - protein, 356 aa, Artificial Sequence
  Synthetic Polypeptide
MEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6914 - protein, 351 aa, Artificial Sequence
  Synthetic Polypeptide
MQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6915 - protein, 361 aa, Artificial Sequence
  Synthetic Polypeptide
MDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6916 - protein, 353 aa, Artificial Sequence
  Synthetic Polypeptide
MDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6917 - protein, 356 aa, Artificial Sequence
  Synthetic Polypeptide
MDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6918 - protein, 366 aa, Artificial Sequence
  Synthetic Polypeptide
MDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6919 - protein, 363 aa, Artificial Sequence
  Synthetic Polypeptide
MEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6920 - protein, 355 aa, Artificial Sequence
  Synthetic Polypeptide
MDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6921 - protein, 348 aa, Artificial Sequence
  Synthetic Polypeptide
MMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6922 - protein, 353 aa, Artificial Sequence
  Synthetic Polypeptide
MQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6923 - protein, 356 aa, Artificial Sequence
  Synthetic Polypeptide
MDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6924 - protein, 361 aa, Artificial Sequence
  Synthetic Polypeptide
MDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6925 - protein, 356 aa, Artificial Sequence
  Synthetic Polypeptide
MDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6926 - protein, 362 aa, Artificial Sequence
  Synthetic Polypeptide
MDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6927 - protein, 360 aa, Artificial Sequence
  Synthetic Polypeptide
MEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6928 - protein, 360 aa, Artificial Sequence
  Synthetic Polypeptide
MEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6929 - protein, 358 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6930 - protein, 355 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6931 - protein, 356 aa, Artificial Sequence
  Synthetic Polypeptide
MDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6932 - protein, 358 aa, Artificial Sequence
  Synthetic Polypeptide
MDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6933 - protein, 359 aa, Artificial Sequence
  Synthetic Polypeptide
MDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6934 - protein, 359 aa, Artificial Sequence
  Synthetic Polypeptide
MDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6935 - protein, 359 aa, Artificial Sequence
  Synthetic Polypeptide
MDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6936 - protein, 357 aa, Artificial Sequence
  Synthetic Polypeptide
MDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6937 - protein, 357 aa, Artificial Sequence
  Synthetic Polypeptide
MDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6938 - protein, 362 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6939 - protein, 362 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6940 - protein, 360 aa, Artificial Sequence
  Synthetic Polypeptide
MDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6941 - protein, 355 aa, Artificial Sequence
  Synthetic Polypeptide
MEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6942 - protein, 350 aa, Artificial Sequence
  Synthetic Polypeptide
MDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6943 - protein, 356 aa, Artificial Sequence
  Synthetic Polypeptide
MDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6944 - protein, 363 aa, Artificial Sequence
  Synthetic Polypeptide
MDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6945 - protein, 364 aa, Artificial Sequence
  Synthetic Polypeptide
MDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6946 - protein, 361 aa, Artificial Sequence
  Synthetic Polypeptide
MDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6947 - protein, 358 aa, Artificial Sequence
  Synthetic Polypeptide
MDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6948 - protein, 369 aa, Artificial Sequence
  Synthetic Polypeptide
MDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6949 - protein, 365 aa, Artificial Sequence
  Synthetic Polypeptide
MQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6950 - protein, 359 aa, Artificial Sequence
  Synthetic Polypeptide
MDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6951 - protein, 356 aa, Artificial Sequence
  Synthetic Polypeptide
MDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6952 - protein, 354 aa, Artificial Sequence
  Synthetic Polypeptide
MDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6953 - protein, 356 aa, Artificial Sequence
  Synthetic Polypeptide
MDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6954 - protein, 358 aa, Artificial Sequence
  Synthetic Polypeptide
MQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6955 - protein, 363 aa, Artificial Sequence
  Synthetic Polypeptide
MQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6956 - protein, 357 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6957 - protein, 358 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6958 - protein, 357 aa, Artificial Sequence
  Synthetic Polypeptide
MQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6959 - protein, 356 aa, Artificial Sequence
  Synthetic Polypeptide
MQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6960 - protein, 356 aa, Artificial Sequence
  Synthetic Polypeptide
MQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6961 - protein, 358 aa, Artificial Sequence
  Synthetic Polypeptide
MQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6962 - protein, 356 aa, Artificial Sequence
  Synthetic Polypeptide
MDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6963 - protein, 355 aa, Artificial Sequence
  Synthetic Polypeptide
MDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6964 - protein, 355 aa, Artificial Sequence
  Synthetic Polypeptide
MDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6965 - protein, 363 aa, Artificial Sequence
  Synthetic Polypeptide
MDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6966 - protein, 369 aa, Artificial Sequence
  Synthetic Polypeptide
MQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6967 - protein, 354 aa, Artificial Sequence
  Synthetic Polypeptide
MEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6968 - protein, 364 aa, Artificial Sequence
  Synthetic Polypeptide
MELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6969 - protein, 360 aa, Artificial Sequence
  Synthetic Polypeptide
MDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6970 - protein, 344 aa, Artificial Sequence
  Synthetic Polypeptide
MDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6971 - protein, 354 aa, Artificial Sequence
  Synthetic Polypeptide
MDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6972 - protein, 358 aa, Artificial Sequence
  Synthetic Polypeptide
MDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6973 - protein, 354 aa, Artificial Sequence
  Synthetic Polypeptide
MDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6974 - protein, 355 aa, Artificial Sequence
  Synthetic Polypeptide
MDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6975 - protein, 360 aa, Artificial Sequence
  Synthetic Polypeptide
MDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6976 - protein, 354 aa, Artificial Sequence
  Synthetic Polypeptide
MDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6977 - protein, 355 aa, Artificial Sequence
  Synthetic Polypeptide
MDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6978 - protein, 363 aa, Artificial Sequence
  Synthetic Polypeptide
MDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6979 - protein, 359 aa, Artificial Sequence; identical to SEQ ID NO: 6896
  Synthetic Polypeptide

SEQ ID NO: 6980 - protein, 356 aa, Artificial Sequence
  Synthetic Polypeptide
MDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6981 - protein, 356 aa, Artificial Sequence
  Synthetic Polypeptide
MDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6982 - protein, 355 aa, Artificial Sequence
  Synthetic Polypeptide
MDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6983 - protein, 354 aa, Artificial Sequence
  Synthetic Polypeptide
MDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6984 - protein, 355 aa, Artificial Sequence
  Synthetic Polypeptide
MDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6985 - protein, 359 aa, Artificial Sequence
  Synthetic Polypeptide
MDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6986 - protein, 362 aa, Artificial Sequence
  Synthetic Polypeptide
MDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6987 - protein, 364 aa, Artificial Sequence
  Synthetic Polypeptide
MDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6988 - protein, 363 aa, Artificial Sequence
  Synthetic Polypeptide
MDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6989 - protein, 353 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6990 - protein, 355 aa, Artificial Sequence
  Synthetic Polypeptide
MDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6991 - protein, 355 aa, Artificial Sequence
  Synthetic Polypeptide
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6992 - protein, 356 aa, Artificial Sequence
  Synthetic Polypeptide
MAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6993 - protein, 354 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6994 - protein, 373 aa, Artificial Sequence
  Synthetic Polypeptide
MDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6995 - protein, 370 aa, Artificial Sequence
  Synthetic Polypeptide
MDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6996 - protein, 344 aa, Artificial Sequence
  Synthetic Polypeptide
MDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6997 - protein, 360 aa, Artificial Sequence
  Synthetic Polypeptide
MDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6998 - protein, 351 aa, Artificial Sequence
  Synthetic Polypeptide
MDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 6999 - protein, 352 aa, Artificial Sequence
  Synthetic Polypeptide
MDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7000 - protein, 352 aa, Artificial Sequence
  Synthetic Polypeptide
MDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7001 - protein, 363 aa, Artificial Sequence
  Synthetic Polypeptide
MEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7002 - protein, 359 aa, Artificial Sequence
  Synthetic Polypeptide
MQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7003 - protein, 354 aa, Artificial Sequence
  Synthetic Polypeptide
MENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7004 - protein, 358 aa, Artificial Sequence
  Synthetic Polypeptide
MDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7005 - protein, 367 aa, Artificial Sequence
  Synthetic Polypeptide
MDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7006 - protein, 358 aa, Artificial Sequence
  Synthetic Polypeptide
MDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7007 - protein, 361 aa, Artificial Sequence
  Synthetic Polypeptide
MDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7008 - protein, 356 aa, Artificial Sequence
  Synthetic Polypeptide
MDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7009 - protein, 357 aa, Artificial Sequence
  Synthetic Polypeptide
MEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7010 - protein, 354 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7011 - protein, 366 aa, Artificial Sequence
  Synthetic Polypeptide
MDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7012 - protein, 356 aa, Artificial Sequence
  Synthetic Polypeptide
MEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7013 - protein, 353 aa, Artificial Sequence
  Synthetic Polypeptide
MDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7014 - protein, 358 aa, Artificial Sequence
  Synthetic Polypeptide
MDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7015 - protein, 357 aa, Artificial Sequence
  Synthetic Polypeptide
MDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7016 - protein, 359 aa, Artificial Sequence
  Synthetic Polypeptide
MDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7017 - protein, 355 aa, Artificial Sequence
  Synthetic Polypeptide
MQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7018 - protein, 353 aa, Artificial Sequence
  Synthetic Polypeptide
MDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7019 - protein, 364 aa, Artificial Sequence
  Synthetic Polypeptide
MAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7020 - protein, 359 aa, Artificial Sequence
  Synthetic Polypeptide
MDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7021 - protein, 360 aa, Artificial Sequence
  Synthetic Polypeptide
MDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7022 - protein, 360 aa, Artificial Sequence
  Synthetic Polypeptide
MDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7023 - protein, 360 aa, Artificial Sequence
  Synthetic Polypeptide
MQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7024 - protein, 354 aa, Artificial Sequence
  Synthetic Polypeptide
MDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7025 - protein, 356 aa, Artificial Sequence
  Synthetic Polypeptide
MEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7026 - protein, 355 aa, Artificial Sequence
  Synthetic Polypeptide
MELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7027 - protein, 357 aa, Artificial Sequence
  Synthetic Polypeptide
MDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7028 - protein, 348 aa, Artificial Sequence
  Synthetic Polypeptide
MDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7029 - protein, 351 aa, Artificial Sequence
  Synthetic Polypeptide
MDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7030 - protein, 358 aa, Artificial Sequence
  Synthetic Polypeptide
MDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7031 - protein, 354 aa, Artificial Sequence
  Synthetic Polypeptide
MDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7032 - protein, 355 aa, Artificial Sequence
  Synthetic Polypeptide
MEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7033 - protein, 356 aa, Artificial Sequence
  Synthetic Polypeptide
MEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7034 - protein, 361 aa, Artificial Sequence
  Synthetic Polypeptide
MDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7035 - protein, 368 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7036 - protein, 362 aa, Artificial Sequence
  Synthetic Polypeptide
MEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7037 - protein, 367 aa, Artificial Sequence
  Synthetic Polypeptide
MDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7038 - protein, 364 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7039 - protein, 369 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7040 - protein, 374 aa, Artificial Sequence
  Synthetic Polypeptide
MDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7041 - protein, 379 aa, Artificial Sequence
  Synthetic Polypeptide
MDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7042 - protein, 370 aa, Artificial Sequence
  Synthetic Polypeptide
MEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7043 - protein, 366 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7044 - protein, 371 aa, Artificial Sequence
  Synthetic Polypeptide
MDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7045 - protein, 361 aa, Artificial Sequence
  Synthetic Polypeptide
MDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7046 - protein, 361 aa, Artificial Sequence
  Synthetic Polypeptide
MEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7047 - protein, 365 aa, Artificial Sequence
  Synthetic Polypeptide
MEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7048 - protein, 369 aa, Artificial Sequence
  Synthetic Polypeptide
MDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7049 - protein, 369 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7050 - protein, 371 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7051 - protein, 371 aa, Artificial Sequence
  Synthetic Polypeptide
MDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7052 - protein, 368 aa, Artificial Sequence
  Synthetic Polypeptide
MEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7053 - protein, 368 aa, Artificial Sequence
  Synthetic Polypeptide
MQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7054 - protein, 374 aa, Artificial Sequence
  Synthetic Polypeptide
MDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7055 - protein, 374 aa, Artificial Sequence
  Synthetic Polypeptide
MQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7056 - protein, 364 aa, Artificial Sequence
  Synthetic Polypeptide
MDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7057 - protein, 364 aa, Artificial Sequence
  Synthetic Polypeptide
MQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7058 - protein, 344 aa, Artificial Sequence
  Synthetic Polypeptide
MEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQWRRRPSRNHSRRWQNISKGTNMCRPLYRHVGGRQKGGQRSQTFQIHVGKTRSHGMGGGRGSNVRRPTRAHHQPRLRIRRYRTSRNYSPSRYLGVRRTVEARKGAGAETDLGRGSV

SEQ ID NO: 7059 - protein, 344 aa, Artificial Sequence; identical to SEQ ID NO: 7058
  Synthetic Polypeptide

SEQ ID NO: 7060 - protein, 347 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQWRRRPSRNHSRRWQNISKGTNMCRPLYRHVGGRQKGGQRSQTFQIHVGKTRSHGMGGGRGSNVRRPTRAHHQPRLRIRRYRTSRNYSPSRYLGVRRTVEARKGAGAETDLGRGSV

SEQ ID NO: 7061 - protein, 347 aa, Artificial Sequence; identical to SEQ ID NO: 7060
  Synthetic Polypeptide

SEQ ID NO: 7062 - protein, 369 aa, Artificial Sequence
  Synthetic Polypeptide
MDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7063 - protein, 369 aa, Artificial Sequence
  Synthetic Polypeptide
MQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7064 - protein, 372 aa, Artificial Sequence
  Synthetic Polypeptide
MQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7065 - protein, 372 aa, Artificial Sequence
  Synthetic Polypeptide
MQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7066 - protein, 364 aa, Artificial Sequence
  Synthetic Polypeptide
MDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7067 - protein, 364 aa, Artificial Sequence
  Synthetic Polypeptide
MQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7068 - protein, 372 aa, Artificial Sequence
  Synthetic Polypeptide
MDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7069 - protein, 372 aa, Artificial Sequence
  Synthetic Polypeptide
MQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7070 - protein, 367 aa, Artificial Sequence
  Synthetic Polypeptide
MDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7071 - protein, 367 aa, Artificial Sequence
  Synthetic Polypeptide
MEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7072 - protein, 364 aa, Artificial Sequence
  Synthetic Polypeptide
MDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7073 - protein, 364 aa, Artificial Sequence
  Synthetic Polypeptide
MEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7074 - protein, 364 aa, Artificial Sequence
  Synthetic Polypeptide
MDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7075 - protein, 364 aa, Artificial Sequence
  Synthetic Polypeptide
MEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7076 - protein, 372 aa, Artificial Sequence
  Synthetic Polypeptide
MQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7077 - protein, 372 aa, Artificial Sequence
  Synthetic Polypeptide
MQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7078 - protein, 379 aa, Artificial Sequence
  Synthetic Polypeptide
MDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7079 - protein, 379 aa, Artificial Sequence
  Synthetic Polypeptide
MEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDELEQKLISEEDL

SEQ ID NO: 7080 - protein, 352 aa, Artificial Sequence
  Synthetic Polypeptide
MVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7081 - protein, 355 aa, Artificial Sequence
  Synthetic Polypeptide
MEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7082 - protein, 360 aa, Artificial Sequence
  Synthetic Polypeptide
MDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7083 - protein, 363 aa, Artificial Sequence
  Synthetic Polypeptide
MDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7084 - protein, 361 aa, Artificial Sequence
  Synthetic Polypeptide
MDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7085 - protein, 362 aa, Artificial Sequence
  Synthetic Polypeptide
MDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7086 - protein, 358 aa, Artificial Sequence
  Synthetic Polypeptide
MDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7087 - protein, 360 aa, Artificial Sequence
  Synthetic Polypeptide
MSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7088 - protein, 355 aa, Artificial Sequence
  Synthetic Polypeptide
MQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7089 - protein, 356 aa, Artificial Sequence
  Synthetic Polypeptide
MDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEKDEL

SEQ ID NO: 7090 - skipped

SEQ ID NO: 7091 - protein, 356 aa, Artificial Sequence
  Synthetic Polypeptide
MDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7092 - protein, 356 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7093 - protein, 356 aa, Artificial Sequence
  Synthetic Polypeptide
MEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7094 - protein, 357 aa, Artificial Sequence
  Synthetic Polypeptide
MDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7095 - protein, 364 aa, Artificial Sequence
  Synthetic Polypeptide
MDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7096 - protein, 381 aa, Artificial Sequence
  Synthetic Polypeptide
MINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7097 - protein, 358 aa, Artificial Sequence
  Synthetic Polypeptide
MDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7098 - protein, 357 aa, Artificial Sequence
  Synthetic Polypeptide
MQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7099 - protein, 363 aa, Artificial Sequence
  Synthetic Polypeptide
MQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7100 - protein, 368 aa, Artificial Sequence
  Synthetic Polypeptide
MQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7101 - protein, 355 aa, Artificial Sequence
  Synthetic Polypeptide
MDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7102 - protein, 365 aa, Artificial Sequence
  Synthetic Polypeptide
MDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7103 - protein, 356 aa, Artificial Sequence
  Synthetic Polypeptide
MDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7104 - protein, 360 aa, Artificial Sequence
  Synthetic Polypeptide
MDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7105 - protein, 358 aa, Artificial Sequence
  Synthetic Polypeptide
MDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7106 - protein, 358 aa, Artificial Sequence
  Synthetic Polypeptide
MDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7107 - protein, 359 aa, Artificial Sequence
  Synthetic Polypeptide
MQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7108 - protein, 357 aa, Artificial Sequence
  Synthetic Polypeptide
MQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7109 - protein, 368 aa, Artificial Sequence
  Synthetic Polypeptide
MLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7110 - protein, 357 aa, Artificial Sequence
  Synthetic Polypeptide
MDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7111 - protein, 358 aa, Artificial Sequence
  Synthetic Polypeptide
MDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7112 - protein, 359 aa, Artificial Sequence
  Synthetic Polypeptide
MDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7113 - protein, 359 aa, Artificial Sequence
  Synthetic Polypeptide
MDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7114 - protein, 359 aa, Artificial Sequence; identical to SEQ ID NO: 7113
  Synthetic Polypeptide

SEQ ID NO: 7115 - protein, 359 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7116 - protein, 361 aa, Artificial Sequence
  Synthetic Polypeptide
MDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7117 - protein, 358 aa, Artificial Sequence
  Synthetic Polypeptide
MDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7118 - protein, 361 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7119 - protein, 359 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7120 - protein, 358 aa, Artificial Sequence
  Synthetic Polypeptide
MDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7121 - protein, 368 aa, Artificial Sequence
  Synthetic Polypeptide
MSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7122 - protein, 360 aa, Artificial Sequence
  Synthetic Polypeptide
MQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7123 - protein, 358 aa, Artificial Sequence; identical to SEQ ID NO: 7120
  Synthetic Polypeptide

SEQ ID NO: 7124 - protein, 357 aa, Artificial Sequence
  Synthetic Polypeptide
MEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7125 - protein, 359 aa, Artificial Sequence
  Synthetic Polypeptide
MDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7126 - protein, 357 aa, Artificial Sequence
  Synthetic Polypeptide
MEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7127 - protein, 362 aa, Artificial Sequence
  Synthetic Polypeptide
MDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7128 - protein, 354 aa, Artificial Sequence
  Synthetic Polypeptide
MDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7129 - protein, 360 aa, Artificial Sequence
  Synthetic Polypeptide
MDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7130 - protein, 360 aa, Artificial Sequence
  Synthetic Polypeptide
MQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7131 - protein, 353 aa, Artificial Sequence
  Synthetic Polypeptide
MDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7132 - protein, 358 aa, Artificial Sequence
  Synthetic Polypeptide
MDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7133 - protein, 355 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7134 - protein, 365 aa, Artificial Sequence
  Synthetic Polypeptide
MDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7135 - protein, 361 aa, Artificial Sequence
  Synthetic Polypeptide
MDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7136 - protein, 387 aa, Artificial Sequence
  Synthetic Polypeptide
MYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7137 - protein, 386 aa, Artificial Sequence
  Synthetic Polypeptide
MYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7138 - protein, 402 aa, Artificial Sequence
  Synthetic Polypeptide
MDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDIGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7139 - protein, 358 aa, Artificial Sequence
  Synthetic Polypeptide
MEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7140 - protein, 357 aa, Artificial Sequence
  Synthetic Polypeptide
MDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7141 - protein, 354 aa, Artificial Sequence
  Synthetic Polypeptide
MDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7142 - protein, 364 aa, Artificial Sequence
  Synthetic Polypeptide
MDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7143 - protein, 351 aa, Artificial Sequence
  Synthetic Polypeptide
MDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7144 - protein, 359 aa, Artificial Sequence
  Synthetic Polypeptide
MDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7145 - protein, 355 aa, Artificial Sequence
  Synthetic Polypeptide
MDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7146 - protein, 359 aa, Artificial Sequence
  Synthetic Polypeptide
MDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7147 - protein, 355 aa, Artificial Sequence
  Synthetic Polypeptide
MDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7148 - protein, 363 aa, Artificial Sequence
  Synthetic Polypeptide
MDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7149 - protein, 358 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7150 - protein, 362 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7151 - protein, 362 aa, Artificial Sequence
  Synthetic Polypeptide
MDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7152 - protein, 356 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7153 - protein, 358 aa, Artificial Sequence
  Synthetic Polypeptide
MQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7154 - protein, 355 aa, Artificial Sequence
  Synthetic Polypeptide
MDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7155 - protein, 356 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7156 - protein, 352 aa, Artificial Sequence
  Synthetic Polypeptide
MDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7157 - protein, 383 aa, Artificial Sequence
  Synthetic Polypeptide
MYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7158 - protein, 354 aa, Artificial Sequence
  Synthetic Polypeptide
MEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7159 - protein, 363 aa, Artificial Sequence
  Synthetic Polypeptide
MDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7160 - protein, 367 aa, Artificial Sequence
  Synthetic Polypeptide
MDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7161 - protein, 358 aa, Artificial Sequence
  Synthetic Polypeptide
MDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7162 - protein, 353 aa, Artificial Sequence
  Synthetic Polypeptide
MDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7163 - protein, 356 aa, Artificial Sequence
  Synthetic Polypeptide
MEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7164 - protein, 351 aa, Artificial Sequence
  Synthetic Polypeptide
MQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7165 - protein, 361 aa, Artificial Sequence
  Synthetic Polypeptide
MDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7166 - protein, 353 aa, Artificial Sequence
  Synthetic Polypeptide
MDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7167 - protein, 356 aa, Artificial Sequence
  Synthetic Polypeptide
MDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7168 - protein, 366 aa, Artificial Sequence
  Synthetic Polypeptide
MDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7169 - protein, 363 aa, Artificial Sequence
  Synthetic Polypeptide
MEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7170 - protein, 355 aa, Artificial Sequence
  Synthetic Polypeptide
MDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7171 - protein, 348 aa, Artificial Sequence
  Synthetic Polypeptide
MMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7172 - protein, 353 aa, Artificial Sequence
  Synthetic Polypeptide
MQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7173 - protein, 356 aa, Artificial Sequence
  Synthetic Polypeptide
MDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7174 - protein, 361 aa, Artificial Sequence
  Synthetic Polypeptide
MDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7175 - protein, 356 aa, Artificial Sequence
  Synthetic Polypeptide
MDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7176 - protein, 362 aa, Artificial Sequence
  Synthetic Polypeptide
MDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7177 - protein, 360 aa, Artificial Sequence
  Synthetic Polypeptide
MEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7178 - protein, 360 aa, Artificial Sequence
  Synthetic Polypeptide
MEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7179 - protein, 358 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7180 - protein, 355 aa, Artificial Sequence
  Synthetic Polypeptide
MDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7181 - protein, 356 aa, Artificial Sequence
  Synthetic Polypeptide
MDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7182 - protein, 358 aa, Artificial Sequence
  Synthetic Polypeptide
MDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7183 - protein, 359 aa, Artificial Sequence
  Synthetic Polypeptide
MDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7184 - protein, 359 aa, Artificial Sequence
  Synthetic Polypeptide
MDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7185 - protein, 359 aa, Artificial Sequence
  Synthetic Polypeptide
MDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7186 - protein, 357 aa, Artificial Sequence
  Synthetic Polypeptide
MDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7187 - protein, 357 aa, Artificial Sequence
  Synthetic Polypeptide
MDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7188 - protein, 362 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7189 - protein, 362 aa, Artificial Sequence
  Synthetic Polypeptide
MQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7190 - protein, 360 aa, Artificial Sequence
  Synthetic Polypeptide
MDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7191 - protein, 355 aa, Artificial Sequence
  Synthetic Polypeptide
MEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7192 - protein, 350 aa, Artificial Sequence
  Synthetic Polypeptide
MDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7193 - protein, 356 aa, Artificial Sequence
  Synthetic Polypeptide
MDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7194 - protein, 363 aa, Artificial Sequence
  Synthetic Polypeptide
MDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7195 - protein, 364 aa, Artificial Sequence
  Synthetic Polypeptide
MDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7196 - protein, 361 aa, Artificial Sequence
  Synthetic Polypeptide
MDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7197 - protein, 358 aa, Artificial Sequence
  Synthetic Polypeptide
MDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7198 - protein, 369 aa, Artificial Sequence
  Synthetic Polypeptide
MDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7199 - protein, 365 aa, Artificial Sequence
  Synthetic Polypeptide
MQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7200 - protein, 359 aa, Artificial Sequence
  Synthetic Polypeptide
MDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7201 - protein, 356 aa, Artificial Sequence
  Synthetic Polypeptide
MDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7202 - protein, 354 aa, Artificial Sequence
  Synthetic Polypeptide
MDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7203 - protein, 356 aa, Artificial Sequence
  Synthetic Polypeptide
MDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7204 - protein, 358 aa, Artificial Sequence
  Synthetic Polypeptide
MQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7205 - protein, 363 aa, Artificial Sequence
  Synthetic Polypeptide
MQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7206 - protein, 357 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7207 - protein, 358 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7208 - protein, 357 aa, Artificial Sequence
  Synthetic Polypeptide
MQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7209 - protein, 356 aa, Artificial Sequence
  Synthetic Polypeptide
MQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7210 - protein, 356 aa, Artificial Sequence
  Synthetic Polypeptide
MQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7211 - protein, 358 aa, Artificial Sequence
  Synthetic Polypeptide
MQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7212 - protein, 356 aa, Artificial Sequence
  Synthetic Polypeptide
MDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7213 - protein, 355 aa, Artificial Sequence
  Synthetic Polypeptide
MDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7214 - protein, 355 aa, Artificial Sequence
  Synthetic Polypeptide
MDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7215 - protein, 363 aa, Artificial Sequence
  Synthetic Polypeptide
MDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7216 - protein, 369 aa, Artificial Sequence
  Synthetic Polypeptide
MQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7217 - protein, 354 aa, Artificial Sequence
  Synthetic Polypeptide
MEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7218 - protein, 364 aa, Artificial Sequence
  Synthetic Polypeptide
MELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7219 - protein, 360 aa, Artificial Sequence
  Synthetic Polypeptide
MDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7220 - protein, 344 aa, Artificial Sequence
  Synthetic Polypeptide
MDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7221 - protein, 354 aa, Artificial Sequence
  Synthetic Polypeptide
MDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7222 - protein, 358 aa, Artificial Sequence
  Synthetic Polypeptide
MDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7223 - protein, 354 aa, Artificial Sequence
  Synthetic Polypeptide
MDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7224 - protein, 355 aa, Artificial Sequence
  Synthetic Polypeptide
MDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7225 - protein, 360 aa, Artificial Sequence
  Synthetic Polypeptide
MDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7226 - protein, 354 aa, Artificial Sequence
  Synthetic Polypeptide
MDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7227 - protein, 355 aa, Artificial Sequence
  Synthetic Polypeptide
MDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7228 - protein, 363 aa, Artificial Sequence
  Synthetic Polypeptide
MDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7229 - protein, 359 aa, Artificial Sequence; identical to SEQ ID NO: 7146
  Synthetic Polypeptide

SEQ ID NO: 7230 - protein, 356 aa, Artificial Sequence
  Synthetic Polypeptide
MDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7231 - protein, 356 aa, Artificial Sequence
  Synthetic Polypeptide
MDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7232 - protein, 355 aa, Artificial Sequence
  Synthetic Polypeptide
MDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7233 - protein, 354 aa, Artificial Sequence
  Synthetic Polypeptide
MDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7234 - protein, 355 aa, Artificial Sequence
  Synthetic Polypeptide
MDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7235 - protein, 359 aa, Artificial Sequence
  Synthetic Polypeptide
MDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7236 - protein, 362 aa, Artificial Sequence
  Synthetic Polypeptide
MDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7237 - protein, 364 aa, Artificial Sequence
  Synthetic Polypeptide
MDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7238 - protein, 363 aa, Artificial Sequence
  Synthetic Polypeptide
MDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7239 - protein, 353 aa, Artificial Sequence
  Synthetic Polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7240 - protein, 355 aa, Artificial Sequence
  Synthetic Polypeptide
MDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7241 - protein, 355 aa, Artificial Sequence
  Synthetic Polypeptide
MDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7242 - protein, 356 aa, Artificial Sequence
  Synthetic Polypeptide
MAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7243 - protein, 354 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7244 - protein, 373 aa, Artificial Sequence
  Synthetic Polypeptide
MDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7245 - protein, 370 aa, Artificial Sequence
  Synthetic Polypeptide
MDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7246 - protein, 344 aa, Artificial Sequence
  Synthetic Polypeptide
MDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7247 - protein, 360 aa, Artificial Sequence
  Synthetic Polypeptide
MDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7248 - protein, 351 aa, Artificial Sequence
  Synthetic Polypeptide
MDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7249 - protein, 352 aa, Artificial Sequence
  Synthetic Polypeptide
MDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7250 - protein, 352 aa, Artificial Sequence
  Synthetic Polypeptide
MDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7251 - protein, 363 aa, Artificial Sequence
  Synthetic Polypeptide
MEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7252 - protein, 359 aa, Artificial Sequence
  Synthetic Polypeptide
MQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7253 - protein, 354 aa, Artificial Sequence
  Synthetic Polypeptide
MENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7254 - protein, 358 aa, Artificial Sequence
  Synthetic Polypeptide
MDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7255 - protein, 367 aa, Artificial Sequence
  Synthetic Polypeptide
MDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7256 - protein, 358 aa, Artificial Sequence
  Synthetic Polypeptide
MDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7257 - protein, 361 aa, Artificial Sequence
  Synthetic Polypeptide
MDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7258 - protein, 356 aa, Artificial Sequence
  Synthetic Polypeptide
MDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7259 - protein, 357 aa, Artificial Sequence
  Synthetic Polypeptide
MEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7260 - protein, 354 aa, Artificial Sequence
  Synthetic Polypeptide
MDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7261 - protein, 366 aa, Artificial Sequence
  Synthetic Polypeptide
MDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7262 - protein, 356 aa, Artificial Sequence
  Synthetic Polypeptide
MEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7263 - protein, 353 aa, Artificial Sequence
  Synthetic Polypeptide
MDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7264 - protein, 358 aa, Artificial Sequence
  Synthetic Polypeptide
MDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7265 - protein, 357 aa, Artificial Sequence
  Synthetic Polypeptide
MDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7266 - protein, 359 aa, Artificial Sequence
  Synthetic Polypeptide
MDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7267 - protein, 355 aa, Artificial Sequence
  Synthetic Polypeptide
MQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7268 - protein, 353 aa, Artificial Sequence
  Synthetic Polypeptide
MDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7269 - protein, 364 aa, Artificial Sequence
  Synthetic Polypeptide
MAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7270 - protein, 359 aa, Artificial Sequence
  Synthetic Polypeptide
MDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7271 - protein, 360 aa, Artificial Sequence
  Synthetic Polypeptide
MDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7272 - protein, 360 aa, Artificial Sequence
  Synthetic Polypeptide
MDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7273 - protein, 360 aa, Artificial Sequence
  Synthetic Polypeptide
MQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7274 - protein, 354 aa, Artificial Sequence
  Synthetic Polypeptide
MDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7275 - protein, 356 aa, Artificial Sequence
  Synthetic Polypeptide
MEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7276 - protein, 355 aa, Artificial Sequence
  Synthetic Polypeptide
MELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7277 - protein, 357 aa, Artificial Sequence
  Synthetic Polypeptide
MDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7278 - protein, 348 aa, Artificial Sequence
  Synthetic Polypeptide
MDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7279 - protein, 351 aa, Artificial Sequence
  Synthetic Polypeptide
MDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7280 - protein, 358 aa, Artificial Sequence
  Synthetic Polypeptide
MDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7281 - protein, 354 aa, Artificial Sequence
  Synthetic Polypeptide
MDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7282 - protein, 355 aa, Artificial Sequence
  Synthetic Polypeptide
MEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7283 - protein, 356 aa, Artificial Sequence
  Synthetic Polypeptide
MEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7284 - protein, 361 aa, Artificial Sequence
  Synthetic Polypeptide
MDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7285 - protein, 368 aa, Artificial Sequence
  Synthetic Polypeptide
MDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7286 - protein, 362 aa, Artificial Sequence
  Synthetic Polypeptide
MEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7287 - protein, 367 aa, Artificial Sequence
  Synthetic Polypeptide
MDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7288 - protein, 364 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7289 - protein, 369 aa, Artificial Sequence
  Synthetic Polypeptide
MEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7290 - protein, 374 aa, Artificial Sequence
  Synthetic Polypeptide
MDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7291 - protein, 379 aa, Artificial Sequence
  Synthetic Polypeptide
MDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7292 - protein, 370 aa, Artificial Sequence
  Synthetic Polypeptide
MEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7293 - protein, 366 aa, Artificial Sequence
  Synthetic Polypeptide
MEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7294 - protein, 371 aa, Artificial Sequence
  Synthetic Polypeptide
MDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7295 - protein, 361 aa, Artificial Sequence
  Synthetic Polypeptide
MDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7296 - protein, 361 aa, Artificial Sequence
  Synthetic Polypeptide
MEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7297 - protein, 365 aa, Artificial Sequence
  Synthetic Polypeptide
MEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7298 - protein, 369 aa, Artificial Sequence
  Synthetic Polypeptide
MDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7299 - protein, 369 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7300 - protein, 371 aa, Artificial Sequence
  Synthetic Polypeptide
MDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7301 - protein, 371 aa, Artificial Sequence
  Synthetic Polypeptide
MDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7302 - protein, 368 aa, Artificial Sequence
  Synthetic Polypeptide
MEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7303 - protein, 368 aa, Artificial Sequence
  Synthetic Polypeptide
MQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7304 - protein, 374 aa, Artificial Sequence
  Synthetic Polypeptide
MDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7305 - protein, 374 aa, Artificial Sequence
  Synthetic Polypeptide
MQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7306 - protein, 364 aa, Artificial Sequence
  Synthetic Polypeptide
MDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7307 - protein, 364 aa, Artificial Sequence
  Synthetic Polypeptide
MQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7308 - protein, 344 aa, Artificial Sequence; identical to SEQ ID NO: 7058
  Synthetic Polypeptide

SEQ ID NO: 7309 - protein, 344 aa, Artificial Sequence; identical to SEQ ID NO: 7058
  Synthetic Polypeptide

SEQ ID NO: 7310 - protein, 347 aa, Artificial Sequence; identical to SEQ ID NO: 7060
  Synthetic Polypeptide

SEQ ID NO: 7311 - protein, 347 aa, Artificial Sequence; identical to SEQ ID NO: 7060
  Synthetic Polypeptide

SEQ ID NO: 7312 - protein, 369 aa, Artificial Sequence
  Synthetic Polypeptide
MDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7313 - protein, 369 aa, Artificial Sequence
  Synthetic Polypeptide
MQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7314 - protein, 372 aa, Artificial Sequence
  Synthetic Polypeptide
MQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7315 - protein, 372 aa, Artificial Sequence
  Synthetic Polypeptide
MQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7316 - protein, 364 aa, Artificial Sequence
  Synthetic Polypeptide
MDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7317 - protein, 364 aa, Artificial Sequence
  Synthetic Polypeptide
MQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7318 - protein, 372 aa, Artificial Sequence
  Synthetic Polypeptide
MDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7319 - protein, 372 aa, Artificial Sequence
  Synthetic Polypeptide
MQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7320 - protein, 367 aa, Artificial Sequence
  Synthetic Polypeptide
MDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7321 - protein, 367 aa, Artificial Sequence
  Synthetic Polypeptide
MEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7322 - protein, 364 aa, Artificial Sequence
  Synthetic Polypeptide
MDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7323 - protein, 364 aa, Artificial Sequence
  Synthetic Polypeptide
MEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7324 - protein, 364 aa, Artificial Sequence
  Synthetic Polypeptide
MDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7325 - protein, 364 aa, Artificial Sequence
  Synthetic Polypeptide
MEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7326 - protein, 372 aa, Artificial Sequence
  Synthetic Polypeptide
MQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7327 - protein, 372 aa, Artificial Sequence
  Synthetic Polypeptide
MQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7328 - protein, 379 aa, Artificial Sequence
  Synthetic Polypeptide
MDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7329 - protein, 379 aa, Artificial Sequence
  Synthetic Polypeptide
MEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDELEQKLISEEDL

SEQ ID NO: 7330 - protein, 352 aa, Artificial Sequence
  Synthetic Polypeptide
MVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7331 - protein, 355 aa, Artificial Sequence
  Synthetic Polypeptide
MEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7332 - protein, 360 aa, Artificial Sequence
  Synthetic Polypeptide
MDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7333 - protein, 363 aa, Artificial Sequence
  Synthetic Polypeptide
MDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7334 - protein, 361 aa, Artificial Sequence
  Synthetic Polypeptide
MDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7335 - protein, 362 aa, Artificial Sequence
  Synthetic Polypeptide
MDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7336 - protein, 358 aa, Artificial Sequence
  Synthetic Polypeptide
MDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7337 - protein, 360 aa, Artificial Sequence
  Synthetic Polypeptide
MSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7338 - protein, 355 aa, Artificial Sequence
  Synthetic Polypeptide
MQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSAGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7339 - protein, 356 aa, Artificial Sequence
  Synthetic Polypeptide
MDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPEKDEL

SEQ ID NO: 7340 - skipped

SEQ ID NO: 7341 - protein, 491 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7342 - protein, 491 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7343 - protein, 491 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7344 - protein, 492 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7345 - protein, 499 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7346 - protein, 516 aa, Artificial Sequence
  Synthetic Polypeptide
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7347 - protein, 493 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7348 - protein, 492 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7349 - protein, 498 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7350 - protein, 503 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7351 - protein, 490 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7352 - protein, 500 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7353 - protein, 491 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7354 - protein, 495 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7355 - protein, 493 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7356 - protein, 493 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7357 - protein, 494 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7358 - protein, 492 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7359 - protein, 503 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7360 - protein, 492 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7361 - protein, 493 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7362 - protein, 494 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7363 - protein, 494 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7364 - protein, 494 aa, Artificial Sequence; identical to SEQ ID NO: 7363
  Synthetic Polypeptide

SEQ ID NO: 7365 - protein, 494 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7366 - protein, 496 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7367 - protein, 493 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7368 - protein, 496 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7369 - protein, 494 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7370 - protein, 493 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7371 - protein, 503 aa, Artificial Sequence
  Synthetic Polypeptide
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7372 - protein, 495 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7373 - protein, 493 aa, Artificial Sequence; identical to SEQ ID NO: 7370
  Synthetic Polypeptide

SEQ ID NO: 7374 - protein, 492 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7375 - protein, 494 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7376 - protein, 492 aa, Artificial Sequence
  Synthetic Polypeptide
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7377 - protein, 497 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7378 - protein, 489 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7379 - protein, 495 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7380 - protein, 495 aa, Artificial Sequence
  Synthetic Polypeptide
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7381 - protein, 488 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7382 - protein, 493 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7383 - protein, 490 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7384 - protein, 500 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7385 - protein, 496 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7386 - protein, 522 aa, Artificial Sequence
  Synthetic Polypeptide
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7387 - protein, 521 aa, Artificial Sequence
  Synthetic Polypeptide
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7388 - protein, 537 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7389 - protein, 493 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7390 - protein, 492 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7391 - protein, 489 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7392 - protein, 499 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7393 - protein, 486 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7394 - protein, 494 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7395 - protein, 490 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7396 - protein, 494 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7397 - protein, 490 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7398 - protein, 498 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7399 - protein, 493 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7400 - protein, 497 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7401 - protein, 497 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7402 - protein, 491 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7403 - protein, 493 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7404 - protein, 490 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7405 - protein, 491 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7406 - protein, 487 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7407 - protein, 518 aa, Artificial Sequence
  Synthetic Polypeptide
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7408 - protein, 489 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7409 - protein, 498 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7410 - protein, 502 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7411 - protein, 493 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7412 - protein, 488 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7413 - protein, 491 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7414 - protein, 486 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7415 - protein, 496 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7416 - protein, 488 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7417 - protein, 491 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7418 - protein, 501 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7419 - protein, 498 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7420 - protein, 490 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7421 - protein, 483 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7422 - protein, 488 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7423 - protein, 491 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7424 - protein, 496 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7425 - protein, 491 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7426 - protein, 497 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7427 - protein, 495 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7428 - protein, 495 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7429 - protein, 493 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7430 - protein, 490 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7431 - protein, 491 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7432 - protein, 493 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7433 - protein, 494 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7434 - protein, 494 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7435 - protein, 494 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7436 - protein, 492 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7437 - protein, 492 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7438 - protein, 497 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7439 - protein, 497 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7440 - protein, 495 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7441 - protein, 490 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7442 - protein, 485 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7443 - protein, 491 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7444 - protein, 498 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7445 - protein, 499 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7446 - protein, 496 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7447 - protein, 493 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7448 - protein, 504 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7449 - protein, 500 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7450 - protein, 494 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7451 - protein, 491 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7452 - protein, 489 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7453 - protein, 491 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7454 - protein, 493 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7455 - protein, 498 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7456 - protein, 492 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7457 - protein, 493 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7458 - protein, 492 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7459 - protein, 491 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7460 - protein, 491 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7461 - protein, 493 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7462 - protein, 491 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7463 - protein, 490 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7464 - protein, 490 aa, Artificial Sequence
  Synthetic Polypeptide
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7465 - protein, 498 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7466 - protein, 504 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7467 - protein, 489 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7468 - protein, 499 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7469 - protein, 495 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7470 - protein, 479 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7471 - protein, 489 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7472 - protein, 493 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7473 - protein, 489 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7474 - protein, 490 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7475 - protein, 495 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7476 - protein, 489 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7477 - protein, 490 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7478 - protein, 498 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7479 - protein, 494 aa, Artificial Sequence; identical to SEQ ID NO: 7396
  Synthetic Polypeptide

SEQ ID NO: 7480 - protein, 491 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7481 - protein, 491 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7482 - protein, 490 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7483 - protein, 489 aa, Artificial Sequence
  Synthetic Polypeptide
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7484 - protein, 490 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7485 - protein, 494 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7486 - protein, 497 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7487 - protein, 499 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7488 - protein, 498 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7489 - protein, 488 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7490 - protein, 490 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7491 - protein, 490 aa, Artificial Sequence
  Synthetic Polypeptide
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7492 - protein, 491 aa, Artificial Sequence
  Synthetic Polypeptide
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7493 - protein, 489 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7494 - protein, 508 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7495 - protein, 505 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7496 - protein, 479 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7497 - protein, 495 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7498 - protein, 486 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7499 - protein, 487 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7500 - protein, 487 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7501 - protein, 498 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7502 - protein, 494 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7503 - protein, 489 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7504 - protein, 493 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7505 - protein, 502 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7506 - protein, 493 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7507 - protein, 496 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7508 - protein, 491 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7509 - protein, 492 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7510 - protein, 489 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7511 - protein, 501 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7512 - protein, 491 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7513 - protein, 488 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7514 - protein, 493 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7515 - protein, 492 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7516 - protein, 494 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7517 - protein, 490 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7518 - protein, 488 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7519 - protein, 499 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7520 - protein, 494 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7521 - protein, 495 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7522 - protein, 495 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7523 - protein, 507 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7524 - protein, 501 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7525 - protein, 491 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7526 - protein, 490 aa, Artificial Sequence
  Synthetic Polypeptide
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7527 - protein, 492 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7528 - protein, 483 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7529 - protein, 486 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7530 - protein, 493 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7531 - protein, 489 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7532 - protein, 490 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7533 - protein, 491 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7534 - protein, 496 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7535 - protein, 503 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7536 - protein, 497 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7537 - protein, 502 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7538 - protein, 499 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7539 - protein, 504 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7540 - protein, 509 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7541 - protein, 514 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7542 - protein, 505 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7543 - protein, 501 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7544 - protein, 506 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7545 - protein, 496 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7546 - protein, 496 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7547 - protein, 500 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7548 - protein, 504 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7549 - protein, 504 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7550 - protein, 506 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7551 - protein, 506 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7552 - protein, 503 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7553 - protein, 503 aa, Artificial Sequence
  Synthetic Polypeptide
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7554 - protein, 509 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7555 - protein, 509 aa, Artificial Sequence
  Synthetic Polypeptide
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7556 - protein, 499 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7557 - protein, 499 aa, Artificial Sequence
  Synthetic Polypeptide
MALPVTALLLPLALLLHAARPQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7558 - protein, 479 aa, Artificial Sequence
  Synthetic Polypeptide
MALPVTALLLPLALLLHAARPEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQYAAETDLGRGSGEAHHDASAATTNTGAHHRVAAPVPAPRGVPASGGGRSAHEGAGLRLHLHLGALGRDLWGPSPVTGYHPLLQTGQKETPVYIQTTIYETSTNYSRGRWLLPISRRRRRRMTESEVQQERRRPRVPAGPEPALRAESRTKRGVRCFGQETWPGPDGGKAEKEEPSGRPVQTAERDGGGLQDWDERRAPEGQGARWPLPGSQYSHQGHLRRPSHAGPAPSL

SEQ ID NO: 7559 - protein, 479 aa, Artificial Sequence; identical to SEQ ID NO: 7558
  Synthetic Polypeptide

SEQ ID NO: 7560 - protein, 482 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQYAAETDLGRGSGEAHHDASAATTNTGAHHRVAAPVPAPRGVPASGGGRSAHEGAGLRLHLHLGALGRDLWGPSPVTGYHPLLQTGQKETPVYIQTTIYETSTNYSRGRWLLPISRRRRRRMTESEVQQERRRPRVPAGPEPALRAESRTKRGVRCFGQETWPGPDGGKAEKEEPSGRPVQTAERDGGGLQDWDERRAPEGQGARWPLPGSQYSHQGHLRRPSHAGPAPSL

SEQ ID NO: 7561 - protein, 482 aa, Artificial Sequence; identical to SEQ ID NO: 7560
  Synthetic Polypeptide

SEQ ID NO: 7562 - protein, 504 aa, Artificial Sequence
  Synthetic Polypeptide
MALPVTALLLPLALLLHAARPDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7563 - protein, 504 aa, Artificial Sequence
  Synthetic Polypeptide
MALPVTALLLPLALLLHAARPQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7564 - protein, 507 aa, Artificial Sequence
  Synthetic Polypeptide
MALPVTALLLPLALLLHAARPQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7565 - protein, 507 aa, Artificial Sequence
  Synthetic Polypeptide
MALPVTALLLPLALLLHAARPQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7566 - protein, 499 aa, Artificial Sequence
  Synthetic Polypeptide
MALPVTALLLPLALLLHAARPDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7567 - protein, 499 aa, Artificial Sequence
  Synthetic Polypeptide
MALPVTALLLPLALLLHAARPQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7568 - protein, 507 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7569 - protein, 507 aa, Artificial Sequence
  Synthetic Polypeptide
MALPVTALLLPLALLLHAARPQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7570 - protein, 502 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7571 - protein, 502 aa, Artificial Sequence
  Synthetic Polypeptide
MALPVTALLLPLALLLHAARPEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7572 - protein, 499 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7573 - protein, 499 aa, Artificial Sequence
  Synthetic Polypeptide
MALPVTALLLPLALLLHAARPEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7574 - protein, 499 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7575 - protein, 499 aa, Artificial Sequence
  Synthetic Polypeptide
MALPVTALLLPLALLLHAARPEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7576 - protein, 507 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7577 - protein, 507 aa, Artificial Sequence
  Synthetic Polypeptide
MALPVTALLLPLALLLHAARPQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7578 - protein, 514 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7579 - protein, 514 aa, Artificial Sequence
  Synthetic Polypeptide
MALPVTALLLPLALLLHAARPEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7580 - protein, 487 aa, Artificial Sequence
  Synthetic Polypeptide
MALPVTALLLPLALLLHAARPVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7581 - protein, 490 aa, Artificial Sequence
  Synthetic Polypeptide
MALPVTALLLPLALLLHAARPEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7582 - protein, 495 aa, Artificial Sequence
  Synthetic Polypeptide
MALPVTALLLPLALLLHAARPDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7583 - protein, 498 aa, Artificial Sequence
  Synthetic Polypeptide
MALPVTALLLPLALLLHAARPDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7584 - protein, 496 aa, Artificial Sequence
  Synthetic Polypeptide
MALPVTALLLPLALLLHAARPDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7585 - protein, 497 aa, Artificial Sequence
  Synthetic Polypeptide
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7586 - protein, 493 aa, Artificial Sequence
  Synthetic Polypeptide
MALPVTALLLPLALLLHAARPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7587 - protein, 495 aa, Artificial Sequence
  Synthetic Polypeptide
MALPVTALLLPLALLLHAARPSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7588 - protein, 490 aa, Artificial Sequence
  Synthetic Polypeptide
MALPVTALLLPLALLLHAARPQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSATRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7589 - protein, 491 aa, Artificial Sequence
  Synthetic Polypeptide
MALPVTALLLPLALLLHAARPDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 7590 - protein, 340 aa, Artificial Sequence
  Synthetic Polypeptide
MALPVTALLLPLALLLHAARPDIVLTQSPASLAVSLGQRATISCRASESVDDYGISFMNWFQQKPGQPPKLLIYAAPNQGSGVPARFSGSGSGTDFSLNIHPMEEDDTAMYFCQQSKDVRWRHQAGDQTGGGGSGGGGSGGGGSEVKLVESGGGLVQPGGSLKLSCAASGFDFSRYWMSWVRQAPGKGLEWIGEINLDSSTINYTPSLKDKFIISRDNAKNTLYLQMSKVRSEDTALYYCARRYDAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7591 - protein, 343 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVAKPTTTPAPRPPTPAPTIASQPLSLRPEACRPAAGGAVHTRGLDFACDIYIWAPLAGTCGVLLLSLVITLYCKRGRKK

SEQ ID NO: 7592 - protein, 343 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7593 - protein, 343 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7594 - protein, 344 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7595 - protein, 351 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7596 - protein, 368 aa, Artificial Sequence
  Synthetic Polypeptide
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7597 - protein, 345 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7598 - protein, 344 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7599 - protein, 350 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7600 - protein, 355 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7601 - protein, 342 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRAKPTTTPAPRPPTPAPTIASQPLSLRPEACRPAAGGAVHTRGLDFACDIYIWAPLAGTCGVLLLSLVITLYCKRGRKK

SEQ ID NO: 7602 - protein, 352 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7603 - protein, 343 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7604 - protein, 347 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRAKPTTTPAPRPPTPAPTIASQPLSLRPEACRPAAGGAVHTRGLDFACDIYIWAPLAGTCGVLLLSLVITLYCKRGRKK

SEQ ID NO: 7605 - protein, 345 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7606 - protein, 345 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7607 - protein, 346 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7608 - protein, 344 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7609 - protein, 355 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7610 - protein, 344 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7611 - protein, 345 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7612 - protein, 346 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7613 - protein, 346 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7614 - protein, 346 aa, Artificial Sequence; identical to SEQ ID NO: 7613
  Synthetic Polypeptide

SEQ ID NO: 7615 - protein, 346 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7616 - protein, 348 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7617 - protein, 345 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7618 - protein, 348 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7619 - protein, 346 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7620 - protein, 345 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7621 - protein, 355 aa, Artificial Sequence
  Synthetic Polypeptide
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRAKPTTTPAPRPPTPAPTIASQPLSLRPEACRPAAGGAVHTRGLDFACDIYIWAPLAGTCGVLLLSLVITLYCKRGRKK

SEQ ID NO: 7622 - protein, 347 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRAKPTTTPAPRPPTPAPTIASQPLSLRPEACRPAAGGAVHTRGLDFACDIYIWAPLAGTCGVLLLSLVITLYCKRGRKK

SEQ ID NO: 7623 - protein, 345 aa, Artificial Sequence; identical to SEQ ID NO: 7620
  Synthetic Polypeptide

SEQ ID NO: 7624 - protein, 344 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7625 - protein, 346 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7626 - protein, 344 aa, Artificial Sequence
  Synthetic Polypeptide
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7627 - protein, 349 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7628 - protein, 341 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7629 - protein, 347 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7630 - protein, 347 aa, Artificial Sequence
  Synthetic Polypeptide
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRAKPTTTPAPRPPTPAPTIASQPLSLRPEACRPAAGGAVHTRGLDFACDIYIWAPLAGTCGVLLLSLVITLYCKRGRKK

SEQ ID NO: 7631 - protein, 340 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7632 - protein, 345 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7633 - protein, 342 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7634 - protein, 352 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7635 - protein, 348 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7636 - protein, 374 aa, Artificial Sequence
  Synthetic Polypeptide
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRAKPTTTPAPRPPTPAPTIASQPLSLRPEACRPAAGGAVHTRGLDFACDIYIWAPLAGTCGVLLLSLVITLYCKRGRKK

SEQ ID NO: 7637 - protein, 373 aa, Artificial Sequence
  Synthetic Polypeptide
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRAKPTTTPAPRPPTPAPTIASQPLSLRPEACRPAAGGAVHTRGLDFACDIYIWAPLAGTCGVLLLSLVITLYCKRGRKK

SEQ ID NO: 7638 - protein, 389 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRAKPTTTPAPRPPTPAPTIASQPLSLRPEACRPAAGGAVHTRGLDFACDIYIWAPLAGTCGVLLLSLVITLYCKRGRKK

SEQ ID NO: 7639 - protein, 345 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7640 - protein, 344 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7641 - protein, 341 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7642 - protein, 351 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7643 - protein, 338 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7644 - protein, 346 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7645 - protein, 342 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7646 - protein, 346 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7647 - protein, 342 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7648 - protein, 350 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7649 - protein, 345 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7650 - protein, 349 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7651 - protein, 349 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7652 - protein, 343 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7653 - protein, 345 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7654 - protein, 342 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7655 - protein, 343 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7656 - protein, 339 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7657 - protein, 370 aa, Artificial Sequence
  Synthetic Polypeptide
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7658 - protein, 341 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7659 - protein, 350 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7660 - protein, 354 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7661 - protein, 345 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7662 - protein, 340 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7663 - protein, 343 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7664 - protein, 338 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRAKPTTTPAPRPPTPAPTIASQPLSLRPEACRPAAGGAVHTRGLDFACDIYIWAPLAGTCGVLLLSLVITLYCKRGRKK

SEQ ID NO: 7665 - protein, 348 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7666 - protein, 340 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7667 - protein, 343 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7668 - protein, 353 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7669 - protein, 350 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7670 - protein, 342 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRAKPTTTPAPRPPTPAPTIASQPLSLRPEACRPAAGGAVHTRGLDFACDIYIWAPLAGTCGVLLLSLVITLYCKRGRKK

SEQ ID NO: 7671 - protein, 335 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7672 - protein, 340 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7673 - protein, 343 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7674 - protein, 348 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7675 - protein, 343 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7676 - protein, 349 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7677 - protein, 347 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7678 - protein, 347 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7679 - protein, 345 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7680 - protein, 342 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7681 - protein, 343 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7682 - protein, 345 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7683 - protein, 346 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7684 - protein, 346 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7685 - protein, 346 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7686 - protein, 344 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRAKPTTTPAPRPPTPAPTIASQPLSLRPEACRPAAGGAVHTRGLDFACDIYIWAPLAGTCGVLLLSLVITLYCKRGRKK

SEQ ID NO: 7687 - protein, 344 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7688 - protein, 349 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7689 - protein, 349 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7690 - protein, 347 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7691 - protein, 342 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7692 - protein, 337 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7693 - protein, 343 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRAKPTTTPAPRPPTPAPTIASQPLSLRPEACRPAAGGAVHTRGLDFACDIYIWAPLAGTCGVLLLSLVITLYCKRGRKK

SEQ ID NO: 7694 - protein, 350 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7695 - protein, 351 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7696 - protein, 348 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7697 - protein, 345 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRAKPTTTPAPRPPTPAPTIASQPLSLRPEACRPAAGGAVHTRGLDFACDIYIWAPLAGTCGVLLLSLVITLYCKRGRKK

SEQ ID NO: 7698 - protein, 356 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRAKPTTTPAPRPPTPAPTIASQPLSLRPEACRPAAGGAVHTRGLDFACDIYIWAPLAGTCGVLLLSLVITLYCKRGRKK

SEQ ID NO: 7699 - protein, 352 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRAKPTTTPAPRPPTPAPTIASQPLSLRPEACRPAAGGAVHTRGLDFACDIYIWAPLAGTCGVLLLSLVITLYCKRGRKK

SEQ ID NO: 7700 - protein, 346 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7701 - protein, 343 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7702 - protein, 341 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7703 - protein, 343 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7704 - protein, 345 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7705 - protein, 350 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7706 - protein, 344 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7707 - protein, 345 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7708 - protein, 344 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7709 - protein, 343 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRAKPTTTPAPRPPTPAPTIASQPLSLRPEACRPAAGGAVHTRGLDFACDIYIWAPLAGTCGVLLLSLVITLYCKRGRKK

SEQ ID NO: 7710 - protein, 343 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7711 - protein, 345 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7712 - protein, 343 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRAKPTTTPAPRPPTPAPTIASQPLSLRPEACRPAAGGAVHTRGLDFACDIYIWAPLAGTCGVLLLSLVITLYCKRGRKK

SEQ ID NO: 7713 - protein, 342 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7714 - protein, 342 aa, Artificial Sequence
  Synthetic Polypeptide
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7715 - protein, 350 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRAKPTTTPAPRPPTPAPTIASQPLSLRPEACRPAAGGAVHTRGLDFACDIYIWAPLAGTCGVLLLSLVITLYCKRGRKK

SEQ ID NO: 7716 - protein, 356 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7717 - protein, 341 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7718 - protein, 351 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7719 - protein, 347 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7720 - protein, 331 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7721 - protein, 341 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7722 - protein, 345 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7723 - protein, 341 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7724 - protein, 342 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7725 - protein, 347 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7726 - protein, 341 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7727 - protein, 342 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRAKPTTTPAPRPPTPAPTIASQPLSLRPEACRPAAGGAVHTRGLDFACDIYIWAPLAGTCGVLLLSLVITLYCKRGRKK

SEQ ID NO: 7728 - protein, 350 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRAKPTTTPAPRPPTPAPTIASQPLSLRPEACRPAAGGAVHTRGLDFACDIYIWAPLAGTCGVLLLSLVITLYCKRGRKK

SEQ ID NO: 7729 - protein, 346 aa, Artificial Sequence; identical to SEQ ID NO: 7646
  Synthetic Polypeptide

SEQ ID NO: 7730 - protein, 343 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7731 - protein, 343 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7732 - protein, 342 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7733 - protein, 341 aa, Artificial Sequence
  Synthetic Polypeptide
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRAKPTTTPAPRPPTPAPTIASQPLSLRPEACRPAAGGAVHTRGLDFACDIYIWAPLAGTCGVLLLSLVITLYCKRGRKK

SEQ ID NO: 7734 - protein, 342 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7735 - protein, 346 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7736 - protein, 349 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7737 - protein, 351 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7738 - protein, 350 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7739 - protein, 340 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7740 - protein, 342 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7741 - protein, 342 aa, Artificial Sequence
  Synthetic Polypeptide
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7742 - protein, 343 aa, Artificial Sequence
  Synthetic Polypeptide
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7743 - protein, 341 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7744 - protein, 360 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7745 - protein, 357 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7746 - protein, 331 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7747 - protein, 347 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7748 - protein, 338 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7749 - protein, 339 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7750 - protein, 339 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRAKPTTTPAPRPPTPAPTIASQPLSLRPEACRPAAGGAVHTRGLDFACDIYIWAPLAGTCGVLLLSLVITLYCKRGRKK

SEQ ID NO: 7751 - protein, 350 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7752 - protein, 346 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7753 - protein, 341 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7754 - protein, 345 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7755 - protein, 354 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7756 - protein, 345 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7757 - protein, 348 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7758 - protein, 343 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRAKPTTTPAPRPPTPAPTIASQPLSLRPEACRPAAGGAVHTRGLDFACDIYIWAPLAGTCGVLLLSLVITLYCKRGRKK

SEQ ID NO: 7759 - protein, 344 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7760 - protein, 341 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7761 - protein, 353 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7762 - protein, 343 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7763 - protein, 340 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7764 - protein, 345 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7765 - protein, 344 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7766 - protein, 346 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7767 - protein, 342 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7768 - protein, 340 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7769 - protein, 351 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7770 - protein, 346 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7771 - protein, 347 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7772 - protein, 347 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7773 - protein, 359 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7774 - protein, 353 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7775 - protein, 343 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7776 - protein, 342 aa, Artificial Sequence
  Synthetic Polypeptide
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7777 - protein, 344 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7778 - protein, 335 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7779 - protein, 338 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7780 - protein, 345 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7781 - protein, 341 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7782 - protein, 342 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7783 - protein, 343 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7784 - protein, 348 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7785 - protein, 355 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7786 - protein, 349 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7787 - protein, 354 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7788 - protein, 351 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7789 - protein, 356 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7790 - protein, 361 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7791 - protein, 366 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7792 - protein, 357 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7793 - protein, 353 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7794 - protein, 358 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7795 - protein, 348 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7796 - protein, 348 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7797 - protein, 352 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7798 - protein, 356 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7799 - protein, 356 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7800 - protein, 358 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7801 - protein, 358 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7802 - protein, 355 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7803 - protein, 355 aa, Artificial Sequence
  Synthetic Polypeptide
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7804 - protein, 361 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7805 - protein, 361 aa, Artificial Sequence
  Synthetic Polypeptide
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7806 - protein, 351 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7807 - protein, 351 aa, Artificial Sequence
  Synthetic Polypeptide
MALPVTALLLPLALLLHAARPQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7808 - protein, 338 aa, Artificial Sequence
  Synthetic Polypeptide
MALPVTALLLPLALLLHAARPEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQYAAETDLGRGSGEAHHDASAATTNTGAHHRVAAPVPAPRGVPASGGGRSAHEGAGLRLHLHLGALGRDLWGPSPVTGYHPLLQTGQKEM

SEQ ID NO: 7809 - protein, 338 aa, Artificial Sequence; identical to SEQ ID NO: 7808
  Synthetic Polypeptide

SEQ ID NO: 7810 - protein, 341 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQYAAETDLGRGSGEAHHDASAATTNTGAHHRVAAPVPAPRGVPASGGGRSAHEGAGLRLHLHLGALGRDLWGPSPVTGYHPLLQTGQKEM

SEQ ID NO: 7811 - protein, 341 aa, Artificial Sequence; identical to SEQ ID NO: 7810
  Synthetic Polypeptide

SEQ ID NO: 7812 - protein, 356 aa, Artificial Sequence
  Synthetic Polypeptide
MALPVTALLLPLALLLHAARPDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7813 - protein, 356 aa, Artificial Sequence
  Synthetic Polypeptide
MALPVTALLLPLALLLHAARPQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7814 - protein, 359 aa, Artificial Sequence
  Synthetic Polypeptide
MALPVTALLLPLALLLHAARPQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7815 - protein, 359 aa, Artificial Sequence
  Synthetic Polypeptide
MALPVTALLLPLALLLHAARPQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7816 - protein, 351 aa, Artificial Sequence
  Synthetic Polypeptide
MALPVTALLLPLALLLHAARPDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7817 - protein, 351 aa, Artificial Sequence
  Synthetic Polypeptide
MALPVTALLLPLALLLHAARPQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7818 - protein, 359 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7819 - protein, 359 aa, Artificial Sequence
  Synthetic Polypeptide
MALPVTALLLPLALLLHAARPQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7820 - protein, 354 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7821 - protein, 354 aa, Artificial Sequence
  Synthetic Polypeptide
MALPVTALLLPLALLLHAARPEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7822 - protein, 351 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7823 - protein, 351 aa, Artificial Sequence
  Synthetic Polypeptide
MALPVTALLLPLALLLHAARPEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7824 - protein, 351 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7825 - protein, 351 aa, Artificial Sequence
  Synthetic Polypeptide
MALPVTALLLPLALLLHAARPEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7826 - protein, 359 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7827 - protein, 359 aa, Artificial Sequence
  Synthetic Polypeptide
MALPVTALLLPLALLLHAARPQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7828 - protein, 366 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7829 - protein, 366 aa, Artificial Sequence
  Synthetic Polypeptide
MALPVTALLLPLALLLHAARPEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVTREQKLISEEDLAKPTTTPAPRPPTPAPTIASQPLSLRPEACRPAAGGAVHTRGLDFACDIYIWAPLAGTCGVLLLSLVITLYCKRGRKK

SEQ ID NO: 7830 - protein, 339 aa, Artificial Sequence
  Synthetic Polypeptide
MALPVTALLLPLALLLHAARPVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7831 - protein, 342 aa, Artificial Sequence
  Synthetic Polypeptide
MALPVTALLLPLALLLHAARPEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7832 - protein, 347 aa, Artificial Sequence
  Synthetic Polypeptide
MALPVTALLLPLALLLHAARPDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7833 - protein, 350 aa, Artificial Sequence
  Synthetic Polypeptide
MALPVTALLLPLALLLHAARPDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7834 - protein, 348 aa, Artificial Sequence
  Synthetic Polypeptide
MALPVTALLLPLALLLHAARPDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7835 - protein, 349 aa, Artificial Sequence
  Synthetic Polypeptide
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7836 - protein, 345 aa, Artificial Sequence
  Synthetic Polypeptide
MALPVTALLLPLALLLHAARPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7837 - protein, 347 aa, Artificial Sequence
  Synthetic Polypeptide
MALPVTALLLPLALLLHAARPSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKTRAKPTTTPAPRPPTPAPTIASQPLSLRPEACRPAAGGAVHTRGLDFACDIYIWAPLAGTCGVLLLSLVITLYCKRGRKK

SEQ ID NO: 7838 - protein, 342 aa, Artificial Sequence
  Synthetic Polypeptide
MALPVTALLLPLALLLHAARPQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSATRAKPTTTPAPRPPTPAPTIASQPLSLRPEACRPAAGGAVHTRGLDFACDIYIWAPLAGTCGVLLLSLVITLYCKRGRKK

SEQ ID NO: 7839 - protein, 343 aa, Artificial Sequence
  Synthetic Polypeptide
MALPVTALLLPLALLLHAARPDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSTRAKPTTTPAPRPPTPAPTIASQPLSLRPEACRPAAGGAVHTRGLDFACDIYIWAPLAGTCGVLLLSLVITLYCKRGRKK

SEQ ID NO: 7840 - protein, 466 aa, Artificial Sequence
  Synthetic Polypeptide
MALPVTALLLPLALLLHAARPKEETPETPETDSEEEVTIKANLIFANGSTQTAEFKGTFEKATSEAYAYADTLKKDNGEYTVDVADKGYTLNIKFAGKEKTPEEPKEEVTIKANLIYADGKTQTAEFKGTFEEATAEAYRYADALKKDNGEYTVDVADKGYTLNIKFAGKEKTPEEPKEEVTIKANLIYADGKTQTAEFKGTFEEATAEAYRYADLLAKENGKYTVDVADKGYTLNIKFAGKEKTPEEPKEEVTIKANLIYADGKTQTAEFKGTFAEATAEAYRYADLLAKENGKYTADLEDGGYTINIRFAGKKVDEKPEEKEQVTIKENIYFEDGTVQTATFKGTFAEATAEAYRYADLLSKEHGKYTADLEDGGYTINIRFAGTRAKPTTTPAPRPPTPAPTIASQPLSLRPEACRPAAGGAVHTRGLDFACDIYIWAPLAGTCGVLLLSLVITLYCKRGRKK

SEQ ID NO: 7841 - protein, 343 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVAKPTTTPAPRPPTPAPTIASQPLSLRPEACRPAAGGAVHTRGLDFACDTNATTKAAGGALQSTASLFVVSLSLLHLYS

SEQ ID NO: 7842 - protein, 343 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7843 - protein, 343 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7844 - protein, 344 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7845 - protein, 351 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7846 - protein, 368 aa, Artificial Sequence
  Synthetic Polypeptide
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7847 - protein, 345 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7848 - protein, 344 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7849 - protein, 350 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7850 - protein, 355 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7851 - protein, 342 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRAKPTTTPAPRPPTPAPTIASQPLSLRPEACRPAAGGAVHTRGLDFACDTNATTKAAGGALQSTASLFVVSLSLLHLYS

SEQ ID NO: 7852 - protein, 352 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7853 - protein, 343 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7854 - protein, 347 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRAKPTTTPAPRPPTPAPTIASQPLSLRPEACRPAAGGAVHTRGLDFACDTNATTKAAGGALQSTASLFVVSLSLLHLYS

SEQ ID NO: 7855 - protein, 345 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7856 - protein, 345 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7857 - protein, 346 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7858 - protein, 344 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7859 - protein, 355 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7860 - protein, 344 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7861 - protein, 345 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7862 - protein, 346 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7863 - protein, 346 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7864 - protein, 346 aa, Artificial Sequence; identical to SEQ ID NO: 7863
  Synthetic Polypeptide

SEQ ID NO: 7865 - protein, 346 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7866 - protein, 348 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7867 - protein, 345 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7868 - protein, 348 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7869 - protein, 346 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7870 - protein, 345 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7871 - protein, 355 aa, Artificial Sequence
  Synthetic Polypeptide
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRAKPTTTPAPRPPTPAPTIASQPLSLRPEACRPAAGGAVHTRGLDFACDTNATTKAAGGALQSTASLFVVSLSLLHLYS

SEQ ID NO: 7872 - protein, 347 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRAKPTTTPAPRPPTPAPTIASQPLSLRPEACRPAAGGAVHTRGLDFACDTNATTKAAGGALQSTASLFVVSLSLLHLYS

SEQ ID NO: 7873 - protein, 345 aa, Artificial Sequence; identical to SEQ ID NO: 7870
  Synthetic Polypeptide

SEQ ID NO: 7874 - protein, 344 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7875 - protein, 346 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7876 - protein, 344 aa, Artificial Sequence
  Synthetic Polypeptide
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7877 - protein, 349 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7878 - protein, 341 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7879 - protein, 347 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7880 - protein, 347 aa, Artificial Sequence
  Synthetic Polypeptide
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRAKPTTTPAPRPPTPAPTIASQPLSLRPEACRPAAGGAVHTRGLDFACDTNATTKAAGGALQSTASLFVVSLSLLHLYS

SEQ ID NO: 7881 - protein, 340 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7882 - protein, 345 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7883 - protein, 342 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7884 - protein, 352 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7885 - protein, 348 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7886 - protein, 374 aa, Artificial Sequence
  Synthetic Polypeptide
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRAKPTTTPAPRPPTPAPTIASQPLSLRPEACRPAAGGAVHTRGLDFACDTNATTKAAGGALQSTASLFVVSLSLLHLYS

SEQ ID NO: 7887 - protein, 373 aa, Artificial Sequence
  Synthetic Polypeptide
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRAKPTTTPAPRPPTPAPTIASQPLSLRPEACRPAAGGAVHTRGLDFACDTNATTKAAGGALQSTASLFVVSLSLLHLYS

SEQ ID NO: 7888 - protein, 389 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRAKPTTTPAPRPPTPAPTIASQPLSLRPEACRPAAGGAVHTRGLDFACDTNATTKAAGGALQSTASLFVVSLSLLHLYS

SEQ ID NO: 7889 - protein, 345 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7890 - protein, 344 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7891 - protein, 341 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7892 - protein, 351 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7893 - protein, 338 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7894 - protein, 346 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7895 - protein, 342 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7896 - protein, 346 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7897 - protein, 342 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7898 - protein, 350 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7899 - protein, 345 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7900 - protein, 349 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7901 - protein, 349 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7902 - protein, 343 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7903 - protein, 345 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7904 - protein, 342 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7905 - protein, 343 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7906 - protein, 339 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7907 - protein, 370 aa, Artificial Sequence
  Synthetic Polypeptide
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7908 - protein, 341 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7909 - protein, 350 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7910 - protein, 354 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7911 - protein, 345 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7912 - protein, 340 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7913 - protein, 343 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7914 - protein, 338 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRAKPTTTPAPRPPTPAPTIASQPLSLRPEACRPAAGGAVHTRGLDFACDTNATTKAAGGALQSTASLFVVSLSLLHLYS

SEQ ID NO: 7915 - protein, 348 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7916 - protein, 340 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7917 - protein, 343 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7918 - protein, 353 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7919 - protein, 350 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7920 - protein, 342 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRAKPTTTPAPRPPTPAPTIASQPLSLRPEACRPAAGGAVHTRGLDFACDTNATTKAAGGALQSTASLFVVSLSLLHLYS

SEQ ID NO: 7921 - protein, 335 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7922 - protein, 340 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7923 - protein, 343 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7924 - protein, 348 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRAKPTTTPAPRPPTPAPTIASQPLSLRPEACRPAAGGAVHTRGLDFACDTNATTKAAGGALQSTASLFVVSLSLLHLYS

SEQ ID NO: 7925 - protein, 343 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7926 - protein, 349 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7927 - protein, 347 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7928 - protein, 347 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7929 - protein, 345 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7930 - protein, 342 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7931 - protein, 343 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7932 - protein, 345 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7933 - protein, 346 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7934 - protein, 346 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7935 - protein, 346 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7936 - protein, 344 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRAKPTTTPAPRPPTPAPTIASQPLSLRPEACRPAAGGAVHTRGLDFACDTNATTKAAGGALQSTASLFVVSLSLLHLYS

SEQ ID NO: 7937 - protein, 344 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7938 - protein, 349 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7939 - protein, 349 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7940 - protein, 347 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7941 - protein, 342 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7942 - protein, 337 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7943 - protein, 343 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRAKPTTTPAPRPPTPAPTIASQPLSLRPEACRPAAGGAVHTRGLDFACDTNATTKAAGGALQSTASLFVVSLSLLHLYS

SEQ ID NO: 7944 - protein, 350 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7945 - protein, 351 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7946 - protein, 348 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7947 - protein, 345 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRAKPTTTPAPRPPTPAPTIASQPLSLRPEACRPAAGGAVHTRGLDFACDTNATTKAAGGALQSTASLFVVSLSLLHLYS

SEQ ID NO: 7948 - protein, 356 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRAKPTTTPAPRPPTPAPTIASQPLSLRPEACRPAAGGAVHTRGLDFACDTNATTKAAGGALQSTASLFVVSLSLLHLYS

SEQ ID NO: 7949 - protein, 352 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRAKPTTTPAPRPPTPAPTIASQPLSLRPEACRPAAGGAVHTRGLDFACDTNATTKAAGGALQSTASLFVVSLSLLHLYS

SEQ ID NO: 7950 - protein, 346 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7951 - protein, 343 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7952 - protein, 341 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7953 - protein, 343 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7954 - protein, 345 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7955 - protein, 350 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7956 - protein, 344 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7957 - protein, 345 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7958 - protein, 344 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7959 - protein, 343 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRAKPTTTPAPRPPTPAPTIASQPLSLRPEACRPAAGGAVHTRGLDFACDTNATTKAAGGALQSTASLFVVSLSLLHLYS

SEQ ID NO: 7960 - protein, 343 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7961 - protein, 345 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7962 - protein, 343 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRAKPTTTPAPRPPTPAPTIASQPLSLRPEACRPAAGGAVHTRGLDFACDTNATTKAAGGALQSTASLFVVSLSLLHLYS

SEQ ID NO: 7963 - protein, 342 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7964 - protein, 342 aa, Artificial Sequence
  Synthetic Polypeptide
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7965 - protein, 350 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRAKPTTTPAPRPPTPAPTIASQPLSLRPEACRPAAGGAVHTRGLDFACDTNATTKAAGGALQSTASLFVVSLSLLHLYS

SEQ ID NO: 7966 - protein, 356 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7967 - protein, 341 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRAKPTTTPAPRPPTPAPTIASQPLSLRPEACRPAAGGAVHTRGLDFACDTNATTKAAGGALQSTASLFVVSLSLLHLYS

SEQ ID NO: 7968 - protein, 351 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7969 - protein, 347 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7970 - protein, 331 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7971 - protein, 341 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7972 - protein, 345 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7973 - protein, 341 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRAKPTTTPAPRPPTPAPTIASQPLSLRPEACRPAAGGAVHTRGLDFACDTNATTKAAGGALQSTASLFVVSLSLLHLYS

SEQ ID NO: 7974 - protein, 342 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7975 - protein, 347 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7976 - protein, 341 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7977 - protein, 342 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRAKPTTTPAPRPPTPAPTIASQPLSLRPEACRPAAGGAVHTRGLDFACDTNATTKAAGGALQSTASLFVVSLSLLHLYS

SEQ ID NO: 7978 - protein, 350 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRAKPTTTPAPRPPTPAPTIASQPLSLRPEACRPAAGGAVHTRGLDFACDTNATTKAAGGALQSTASLFVVSLSLLHLYS

SEQ ID NO: 7979 - protein, 346 aa, Artificial Sequence; identical to SEQ ID NO: 7896
  Synthetic Polypeptide

SEQ ID NO: 7980 - protein, 343 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7981 - protein, 343 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7982 - protein, 342 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7983 - protein, 341 aa, Artificial Sequence
  Synthetic Polypeptide
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRAKPTTTPAPRPPTPAPTIASQPLSLRPEACRPAAGGAVHTRGLDFACDTNATTKAAGGALQSTASLFVVSLSLLHLYS

SEQ ID NO: 7984 - protein, 342 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7985 - protein, 346 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7986 - protein, 349 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7987 - protein, 351 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7988 - protein, 350 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7989 - protein, 340 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7990 - protein, 342 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7991 - protein, 342 aa, Artificial Sequence
  Synthetic Polypeptide
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7992 - protein, 343 aa, Artificial Sequence
  Synthetic Polypeptide
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7993 - protein, 341 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7994 - protein, 360 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7995 - protein, 357 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7996 - protein, 331 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRAKPTTTPAPRPPTPAPTIASQPLSLRPEACRPAAGGAVHTRGLDFACDTNATTKAAGGALQSTASLFVVSLSLLHLYS

SEQ ID NO: 7997 - protein, 347 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7998 - protein, 338 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 7999 - protein, 339 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8000 - protein, 339 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRAKPTTTPAPRPPTPAPTIASQPLSLRPEACRPAAGGAVHTRGLDFACDTNATTKAAGGALQSTASLFVVSLSLLHLYS

SEQ ID NO: 8001 - protein, 350 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8002 - protein, 346 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8003 - protein, 341 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8004 - protein, 345 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8005 - protein, 354 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8006 - protein, 345 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8007 - protein, 348 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8008 - protein, 343 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRAKPTTTPAPRPPTPAPTIASQPLSLRPEACRPAAGGAVHTRGLDFACDTNATTKAAGGALQSTASLFVVSLSLLHLYS

SEQ ID NO: 8009 - protein, 344 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8010 - protein, 341 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRAKPTTTPAPRPPTPAPTIASQPLSLRPEACRPAAGGAVHTRGLDFACDTNATTKAAGGALQSTASLFVVSLSLLHLYS

SEQ ID NO: 8011 - protein, 353 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8012 - protein, 343 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8013 - protein, 340 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8014 - protein, 345 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8015 - protein, 344 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8016 - protein, 346 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8017 - protein, 342 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8018 - protein, 340 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8019 - protein, 351 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8020 - protein, 346 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8021 - protein, 347 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8022 - protein, 347 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8023 - protein, 359 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8024 - protein, 353 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8025 - protein, 343 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRAKPTTTPAPRPPTPAPTIASQPLSLRPEACRPAAGGAVHTRGLDFACDTNATTKAAGGALQSTASLFVVSLSLLHLYS

SEQ ID NO: 8026 - protein, 342 aa, Artificial Sequence
  Synthetic Polypeptide
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8027 - protein, 344 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8028 - protein, 335 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8029 - protein, 338 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8030 - protein, 345 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8031 - protein, 341 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8032 - protein, 342 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8033 - protein, 343 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8034 - protein, 348 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8035 - protein, 355 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8036 - protein, 349 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8037 - protein, 354 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8038 - protein, 351 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8039 - protein, 356 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8040 - protein, 361 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8041 - protein, 366 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8042 - protein, 357 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8043 - protein, 353 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8044 - protein, 358 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8045 - protein, 348 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8046 - protein, 348 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8047 - protein, 352 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8048 - protein, 356 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8049 - protein, 356 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8050 - protein, 358 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8051 - protein, 358 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8052 - protein, 355 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8053 - protein, 355 aa, Artificial Sequence
  Synthetic Polypeptide
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8054 - protein, 361 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8055 - protein, 361 aa, Artificial Sequence
  Synthetic Polypeptide
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8056 - protein, 351 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8057 - protein, 351 aa, Artificial Sequence
  Synthetic Polypeptide
MALPVTALLLPLALLLHAARPQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8058 - protein, 336 aa, Artificial Sequence
  Synthetic Polypeptide
MALPVTALLLPLALLLHAARPEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQYAAETDLGRGSGEAHHDASAATTNTGAHHRVAAPVPAPRGVPASGGGRSAHEGAGLRLHCYNQSCGGSFAVYSLTLRCKPPVAPLLL

SEQ ID NO: 8059 - protein, 336 aa, Artificial Sequence; identical to SEQ ID NO: 8058
  Synthetic Polypeptide

SEQ ID NO: 8060 - protein, 339 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQYAAETDLGRGSGEAHHDASAATTNTGAHHRVAAPVPAPRGVPASGGGRSAHEGAGLRLHCYNQSCGGSFAVYSLTLRCKPPVAPLLL

SEQ ID NO: 8061 - protein, 339 aa, Artificial Sequence; identical to SEQ ID NO: 8060
  Synthetic Polypeptide

SEQ ID NO: 8062 - protein, 356 aa, Artificial Sequence
  Synthetic Polypeptide
MALPVTALLLPLALLLHAARPDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8063 - protein, 356 aa, Artificial Sequence
  Synthetic Polypeptide
MALPVTALLLPLALLLHAARPQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8064 - protein, 359 aa, Artificial Sequence
  Synthetic Polypeptide
MALPVTALLLPLALLLHAARPQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8065 - protein, 359 aa, Artificial Sequence
  Synthetic Polypeptide
MALPVTALLLPLALLLHAARPQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8066 - protein, 351 aa, Artificial Sequence
  Synthetic Polypeptide
MALPVTALLLPLALLLHAARPDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8067 - protein, 351 aa, Artificial Sequence
  Synthetic Polypeptide
MALPVTALLLPLALLLHAARPQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8068 - protein, 359 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8069 - protein, 359 aa, Artificial Sequence
  Synthetic Polypeptide
MALPVTALLLPLALLLHAARPQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8070 - protein, 354 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8071 - protein, 354 aa, Artificial Sequence
  Synthetic Polypeptide
MALPVTALLLPLALLLHAARPEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8072 - protein, 351 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8073 - protein, 351 aa, Artificial Sequence
  Synthetic Polypeptide
MALPVTALLLPLALLLHAARPEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8074 - protein, 351 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8075 - protein, 351 aa, Artificial Sequence
  Synthetic Polypeptide
MALPVTALLLPLALLLHAARPEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8076 - protein, 359 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8077 - protein, 359 aa, Artificial Sequence
  Synthetic Polypeptide
MALPVTALLLPLALLLHAARPQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8078 - protein, 366 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8079 - protein, 366 aa, Artificial Sequence
  Synthetic Polypeptide
MALPVTALLLPLALLLHAARPEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVTREQKLISEEDLAKPTTTPAPRPPTPAPTIASQPLSLRPEACRPAAGGAVHTRGLDFACDTNATTKAAGGALQSTASLFVVSLSLLHLYS

SEQ ID NO: 8080 - protein, 339 aa, Artificial Sequence
  Synthetic Polypeptide
MALPVTALLLPLALLLHAARPVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8081 - protein, 342 aa, Artificial Sequence
  Synthetic Polypeptide
MALPVTALLLPLALLLHAARPEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8082 - protein, 347 aa, Artificial Sequence
  Synthetic Polypeptide
MALPVTALLLPLALLLHAARPDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8083 - protein, 350 aa, Artificial Sequence
  Synthetic Polypeptide
MALPVTALLLPLALLLHAARPDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8084 - protein, 348 aa, Artificial Sequence
  Synthetic Polypeptide
MALPVTALLLPLALLLHAARPDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8085 - protein, 349 aa, Artificial Sequence
  Synthetic Polypeptide
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8086 - protein, 345 aa, Artificial Sequence
  Synthetic Polypeptide
MALPVTALLLPLALLLHAARPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8087 - protein, 347 aa, Artificial Sequence
  Synthetic Polypeptide
MALPVTALLLPLALLLHAARPSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKTRAKPTTTPAPRPPTPAPTIASQPLSLRPEACRPAAGGAVHTRGLDFACDTNATTKAAGGALQSTASLFVVSLSLLHLYS

SEQ ID NO: 8088 - protein, 342 aa, Artificial Sequence
  Synthetic Polypeptide
MALPVTALLLPLALLLHAARPQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSATRAKPTTTPAPRPPTPAPTIASQPLSLRPEACRPAAGGAVHTRGLDFACDTNATTKAAGGALQSTASLFVVSLSLLHLYS

SEQ ID NO: 8089 - protein, 343 aa, Artificial Sequence
  Synthetic Polypeptide
MALPVTALLLPLALLLHAARPDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSTRAKPTTTPAPRPPTPAPTIASQPLSLRPEACRPAAGGAVHTRGLDFACDTNATTKAAGGALQSTASLFVVSLSLLHLYS

SEQ ID NO: 8090 - skipped

SEQ ID NO: 8091 - protein, 446 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8092 - protein, 446 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8093 - protein, 446 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8094 - protein, 447 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8095 - protein, 454 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8096 - protein, 471 aa, Artificial Sequence
  Synthetic Polypeptide
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8097 - protein, 448 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8098 - protein, 447 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8099 - protein, 453 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8100 - protein, 458 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8101 - protein, 445 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8102 - protein, 455 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8103 - protein, 446 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8104 - protein, 450 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8105 - protein, 448 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8106 - protein, 448 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8107 - protein, 449 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8108 - protein, 447 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8109 - protein, 458 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8110 - protein, 447 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8111 - protein, 448 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8112 - protein, 449 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8113 - protein, 449 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8114 - protein, 449 aa, Artificial Sequence; identical to SEQ ID NO: 8113
  Synthetic Polypeptide

SEQ ID NO: 8115 - protein, 449 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8116 - protein, 451 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8117 - protein, 448 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8118 - protein, 451 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8119 - protein, 449 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8120 - protein, 448 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8121 - protein, 458 aa, Artificial Sequence
  Synthetic Polypeptide
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8122 - protein, 450 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8123 - protein, 448 aa, Artificial Sequence; identical to SEQ ID NO: 8120
  Synthetic Polypeptide

SEQ ID NO: 8124 - protein, 447 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8125 - protein, 449 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8126 - protein, 447 aa, Artificial Sequence
  Synthetic Polypeptide
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8127 - protein, 452 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8128 - protein, 444 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8129 - protein, 450 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8130 - protein, 450 aa, Artificial Sequence
  Synthetic Polypeptide
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8131 - protein, 443 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8132 - protein, 448 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8133 - protein, 445 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8134 - protein, 455 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8135 - protein, 451 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8136 - protein, 477 aa, Artificial Sequence
  Synthetic Polypeptide
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8137 - protein, 476 aa, Artificial Sequence
  Synthetic Polypeptide
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8138 - protein, 492 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8139 - protein, 448 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8140 - protein, 447 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8141 - protein, 444 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8142 - protein, 454 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8143 - protein, 441 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8144 - protein, 449 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8145 - protein, 445 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8146 - protein, 449 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8147 - protein, 445 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8148 - protein, 453 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8149 - protein, 448 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8150 - protein, 452 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8151 - protein, 452 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8152 - protein, 446 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8153 - protein, 448 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8154 - protein, 445 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8155 - protein, 446 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8156 - protein, 442 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8157 - protein, 473 aa, Artificial Sequence
  Synthetic Polypeptide
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8158 - protein, 444 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8159 - protein, 453 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8160 - protein, 457 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8161 - protein, 448 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8162 - protein, 443 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8163 - protein, 446 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8164 - protein, 441 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8165 - protein, 451 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8166 - protein, 443 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8167 - protein, 446 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8168 - protein, 456 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8169 - protein, 453 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8170 - protein, 445 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8171 - protein, 438 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8172 - protein, 443 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8173 - protein, 446 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8174 - protein, 451 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8175 - protein, 446 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8176 - protein, 452 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8177 - protein, 450 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8178 - protein, 450 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8179 - protein, 448 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8180 - protein, 445 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8181 - protein, 446 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8182 - protein, 448 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8183 - protein, 449 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8184 - protein, 449 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8185 - protein, 449 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8186 - protein, 447 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8187 - protein, 447 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8188 - protein, 452 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8189 - protein, 452 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8190 - protein, 450 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8191 - protein, 445 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8192 - protein, 440 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8193 - protein, 446 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8194 - protein, 453 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8195 - protein, 454 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8196 - protein, 451 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8197 - protein, 448 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8198 - protein, 459 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8199 - protein, 455 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8200 - protein, 449 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8201 - protein, 446 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8202 - protein, 444 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8203 - protein, 446 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8204 - protein, 448 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8205 - protein, 453 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8206 - protein, 447 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8207 - protein, 448 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8208 - protein, 447 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8209 - protein, 446 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8210 - protein, 446 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8211 - protein, 448 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8212 - protein, 446 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8213 - protein, 445 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8214 - protein, 445 aa, Artificial Sequence
  Synthetic Polypeptide
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8215 - protein, 453 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8216 - protein, 459 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8217 - protein, 444 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8218 - protein, 454 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8219 - protein, 450 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8220 - protein, 434 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8221 - protein, 444 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8222 - protein, 448 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8223 - protein, 444 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8224 - protein, 445 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8225 - protein, 450 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8226 - protein, 444 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8227 - protein, 445 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8228 - protein, 453 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8229 - protein, 449 aa, Artificial Sequence; identical to SEQ ID NO: 8146
  Synthetic Polypeptide

SEQ ID NO: 8230 - protein, 446 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8231 - protein, 446 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8232 - protein, 445 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8233 - protein, 444 aa, Artificial Sequence
  Synthetic Polypeptide
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8234 - protein, 445 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8235 - protein, 449 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8236 - protein, 452 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8237 - protein, 454 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8238 - protein, 453 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8239 - protein, 443 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8240 - protein, 445 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8241 - protein, 445 aa, Artificial Sequence
  Synthetic Polypeptide
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8242 - protein, 446 aa, Artificial Sequence
  Synthetic Polypeptide
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8243 - protein, 444 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8244 - protein, 463 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8245 - protein, 460 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8246 - protein, 434 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8247 - protein, 450 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8248 - protein, 441 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8249 - protein, 442 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8250 - protein, 442 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8251 - protein, 453 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8252 - protein, 449 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8253 - protein, 444 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8254 - protein, 448 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8255 - protein, 457 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8256 - protein, 448 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8257 - protein, 451 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8258 - protein, 446 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8259 - protein, 447 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8260 - protein, 444 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8261 - protein, 456 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8262 - protein, 446 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8263 - protein, 443 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8264 - protein, 448 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8265 - protein, 447 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8266 - protein, 449 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8267 - protein, 445 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8268 - protein, 443 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8269 - protein, 454 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8270 - protein, 449 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8271 - protein, 450 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8272 - protein, 450 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8273 - protein, 462 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8274 - protein, 456 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8275 - protein, 446 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8276 - protein, 445 aa, Artificial Sequence
  Synthetic Polypeptide
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8277 - protein, 447 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8278 - protein, 438 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8279 - protein, 441 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8280 - protein, 448 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8281 - protein, 444 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8282 - protein, 445 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8283 - protein, 446 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8284 - protein, 451 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8285 - protein, 458 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8286 - protein, 452 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8287 - protein, 457 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8288 - protein, 454 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8289 - protein, 459 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8290 - protein, 464 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8291 - protein, 469 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8292 - protein, 460 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8293 - protein, 456 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8294 - protein, 461 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8295 - protein, 451 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8296 - protein, 451 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8297 - protein, 455 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8298 - protein, 459 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8299 - protein, 459 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8300 - protein, 461 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8301 - protein, 461 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8302 - protein, 458 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8303 - protein, 458 aa, Artificial Sequence
  Synthetic Polypeptide
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8304 - protein, 464 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8305 - protein, 464 aa, Artificial Sequence
  Synthetic Polypeptide
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8306 - protein, 454 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8307 - protein, 454 aa, Artificial Sequence
  Synthetic Polypeptide
MALPVTALLLPLALLLHAARPQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8308 - protein, 433 aa, Artificial Sequence
  Synthetic Polypeptide
MALPVTALLLPLALLLHAARPEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQYAAETDLGRGSGEAHHDASAATTNTGAHHRVAAPVPAPRGVPASGGGRSAHEGAGLRLHLHLGALGRDLWGPSPVTGYHPLLRRRRPSRNHSRRWQNISKGTNMCRPLYRHVGGRQKGGQRSQTFQIHVGKTRSHGMGGGRGSNVRRPTRAHHQPRLRIRRYRTSRNYSPSRYLGVRRTVEARM

SEQ ID NO: 8309 - protein, 433 aa, Artificial Sequence; identical to SEQ ID NO: 8308
  Synthetic Polypeptide

SEQ ID NO: 8310 - protein, 436 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQYAAETDLGRGSGEAHHDASAATTNTGAHHRVAAPVPAPRGVPASGGGRSAHEGAGLRLHLHLGALGRDLWGPSPVTGYHPLLRRRRPSRNHSRRWQNISKGTNMCRPLYRHVGGRQKGGQRSQTFQIHVGKTRSHGMGGGRGSNVRRPTRAHHQPRLRIRRYRTSRNYSPSRYLGVRRTVEARM

SEQ ID NO: 8311 - protein, 436 aa, Artificial Sequence; identical to SEQ ID NO: 8310
  Synthetic Polypeptide

SEQ ID NO: 8312 - protein, 459 aa, Artificial Sequence
  Synthetic Polypeptide
MALPVTALLLPLALLLHAARPDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8313 - protein, 459 aa, Artificial Sequence
  Synthetic Polypeptide
MALPVTALLLPLALLLHAARPQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8314 - protein, 462 aa, Artificial Sequence
  Synthetic Polypeptide
MALPVTALLLPLALLLHAARPQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8315 - protein, 462 aa, Artificial Sequence
  Synthetic Polypeptide
MALPVTALLLPLALLLHAARPQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8316 - protein, 454 aa, Artificial Sequence
  Synthetic Polypeptide
MALPVTALLLPLALLLHAARPDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8317 - protein, 454 aa, Artificial Sequence
  Synthetic Polypeptide
MALPVTALLLPLALLLHAARPQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8318 - protein, 462 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8319 - protein, 462 aa, Artificial Sequence
  Synthetic Polypeptide
MALPVTALLLPLALLLHAARPQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8320 - protein, 457 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8321 - protein, 457 aa, Artificial Sequence
  Synthetic Polypeptide
MALPVTALLLPLALLLHAARPEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8322 - protein, 454 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8323 - protein, 454 aa, Artificial Sequence
  Synthetic Polypeptide
MALPVTALLLPLALLLHAARPEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8324 - protein, 454 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8325 - protein, 454 aa, Artificial Sequence
  Synthetic Polypeptide
MALPVTALLLPLALLLHAARPEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8326 - protein, 462 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8327 - protein, 462 aa, Artificial Sequence
  Synthetic Polypeptide
MALPVTALLLPLALLLHAARPQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8328 - protein, 469 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8329 - protein, 469 aa, Artificial Sequence
  Synthetic Polypeptide
MALPVTALLLPLALLLHAARPEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8330 - protein, 442 aa, Artificial Sequence
  Synthetic Polypeptide
MALPVTALLLPLALLLHAARPVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8331 - protein, 445 aa, Artificial Sequence
  Synthetic Polypeptide
MALPVTALLLPLALLLHAARPEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8332 - protein, 450 aa, Artificial Sequence
  Synthetic Polypeptide
MALPVTALLLPLALLLHAARPDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8333 - protein, 453 aa, Artificial Sequence
  Synthetic Polypeptide
MALPVTALLLPLALLLHAARPDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8334 - protein, 451 aa, Artificial Sequence
  Synthetic Polypeptide
MALPVTALLLPLALLLHAARPDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8335 - protein, 452 aa, Artificial Sequence
  Synthetic Polypeptide
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8336 - protein, 448 aa, Artificial Sequence
  Synthetic Polypeptide
MALPVTALLLPLALLLHAARPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8337 - protein, 450 aa, Artificial Sequence
  Synthetic Polypeptide
MALPVTALLLPLALLLHAARPSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8338 - protein, 445 aa, Artificial Sequence
  Synthetic Polypeptide
MALPVTALLLPLALLLHAARPQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8339 - protein, 446 aa, Artificial Sequence
  Synthetic Polypeptide
MALPVTALLLPLALLLHAARPDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8340 - skipped

SEQ ID NO: 8341 - protein, 446 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8342 - protein, 446 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8343 - protein, 446 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8344 - protein, 447 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8345 - protein, 454 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8346 - protein, 471 aa, Artificial Sequence
  Synthetic Polypeptide
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8347 - protein, 448 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8348 - protein, 447 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8349 - protein, 453 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8350 - protein, 458 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8351 - protein, 445 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8352 - protein, 455 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8353 - protein, 446 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8354 - protein, 450 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8355 - protein, 448 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8356 - protein, 448 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8357 - protein, 449 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8358 - protein, 447 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8359 - protein, 458 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8360 - protein, 447 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8361 - protein, 448 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8362 - protein, 449 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8363 - protein, 449 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8364 - protein, 449 aa, Artificial Sequence; identical to SEQ ID NO: 8363
  Synthetic Polypeptide

SEQ ID NO: 8365 - protein, 449 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8366 - protein, 451 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8367 - protein, 448 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8368 - protein, 451 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8369 - protein, 449 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8370 - protein, 448 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8371 - protein, 458 aa, Artificial Sequence
  Synthetic Polypeptide
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8372 - protein, 450 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8373 - protein, 448 aa, Artificial Sequence; identical to SEQ ID NO: 8370
  Synthetic Polypeptide

SEQ ID NO: 8374 - protein, 447 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8375 - protein, 449 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8376 - protein, 447 aa, Artificial Sequence
  Synthetic Polypeptide
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8377 - protein, 452 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8378 - protein, 444 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8379 - protein, 450 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8380 - protein, 450 aa, Artificial Sequence
  Synthetic Polypeptide
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8381 - protein, 443 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8382 - protein, 448 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8383 - protein, 445 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8384 - protein, 455 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8385 - protein, 451 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8386 - protein, 477 aa, Artificial Sequence
  Synthetic Polypeptide
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8387 - protein, 476 aa, Artificial Sequence
  Synthetic Polypeptide
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8388 - protein, 492 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8389 - protein, 448 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8390 - protein, 447 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8391 - protein, 444 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8392 - protein, 454 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8393 - protein, 441 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8394 - protein, 449 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8395 - protein, 445 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8396 - protein, 449 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8397 - protein, 445 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8398 - protein, 453 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8399 - protein, 448 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8400 - protein, 452 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8401 - protein, 452 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8402 - protein, 446 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8403 - protein, 448 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8404 - protein, 445 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8405 - protein, 446 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8406 - protein, 442 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8407 - protein, 473 aa, Artificial Sequence
  Synthetic Polypeptide
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8408 - protein, 444 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8409 - protein, 453 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8410 - protein, 457 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8411 - protein, 448 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8412 - protein, 443 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8413 - protein, 446 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8414 - protein, 441 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8415 - protein, 451 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8416 - protein, 443 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8417 - protein, 446 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8418 - protein, 456 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8419 - protein, 453 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8420 - protein, 445 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8421 - protein, 438 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8422 - protein, 443 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8423 - protein, 446 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8424 - protein, 451 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8425 - protein, 446 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8426 - protein, 452 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8427 - protein, 450 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8428 - protein, 450 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8429 - protein, 448 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8430 - protein, 445 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8431 - protein, 446 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8432 - protein, 448 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8433 - protein, 449 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8434 - protein, 449 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8435 - protein, 449 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8436 - protein, 447 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8437 - protein, 447 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8438 - protein, 452 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8439 - protein, 452 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8440 - protein, 450 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8441 - protein, 445 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8442 - protein, 440 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8443 - protein, 446 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8444 - protein, 453 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8445 - protein, 454 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8446 - protein, 451 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8447 - protein, 448 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8448 - protein, 459 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8449 - protein, 455 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8450 - protein, 449 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8451 - protein, 446 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8452 - protein, 444 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8453 - protein, 446 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8454 - protein, 448 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8455 - protein, 453 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8456 - protein, 447 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8457 - protein, 448 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8458 - protein, 447 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8459 - protein, 446 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8460 - protein, 446 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8461 - protein, 448 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8462 - protein, 446 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8463 - protein, 445 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8464 - protein, 445 aa, Artificial Sequence
  Synthetic Polypeptide
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8465 - protein, 453 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8466 - protein, 459 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8467 - protein, 444 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8468 - protein, 454 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8469 - protein, 450 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8470 - protein, 434 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8471 - protein, 444 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8472 - protein, 448 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8473 - protein, 444 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8474 - protein, 445 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8475 - protein, 450 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8476 - protein, 444 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8477 - protein, 445 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8478 - protein, 453 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8479 - protein, 449 aa, Artificial Sequence; identical to SEQ ID NO: 8396
  Synthetic Polypeptide

SEQ ID NO: 8480 - protein, 446 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8481 - protein, 446 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8482 - protein, 445 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8483 - protein, 444 aa, Artificial Sequence
  Synthetic Polypeptide
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8484 - protein, 445 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8485 - protein, 449 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8486 - protein, 452 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8487 - protein, 454 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8488 - protein, 453 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8489 - protein, 443 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8490 - protein, 445 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8491 - protein, 445 aa, Artificial Sequence
  Synthetic Polypeptide
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8492 - protein, 446 aa, Artificial Sequence
  Synthetic Polypeptide
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8493 - protein, 444 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8494 - protein, 463 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8495 - protein, 460 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8496 - protein, 434 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8497 - protein, 450 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8498 - protein, 441 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8499 - protein, 442 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8500 - protein, 442 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8501 - protein, 453 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8502 - protein, 449 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8503 - protein, 444 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8504 - protein, 448 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8505 - protein, 457 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8506 - protein, 448 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8507 - protein, 451 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8508 - protein, 446 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8509 - protein, 447 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8510 - protein, 444 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8511 - protein, 456 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8512 - protein, 446 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8513 - protein, 443 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8514 - protein, 448 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8515 - protein, 447 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8516 - protein, 449 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8517 - protein, 445 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8518 - protein, 443 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8519 - protein, 454 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8520 - protein, 449 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8521 - protein, 450 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8522 - protein, 450 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8523 - protein, 462 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8524 - protein, 456 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8525 - protein, 446 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8526 - protein, 445 aa, Artificial Sequence
  Synthetic Polypeptide
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8527 - protein, 447 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8528 - protein, 438 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8529 - protein, 441 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8530 - protein, 448 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8531 - protein, 444 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8532 - protein, 445 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8533 - protein, 446 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8534 - protein, 451 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8535 - protein, 458 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8536 - protein, 452 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8537 - protein, 457 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8538 - protein, 454 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8539 - protein, 459 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8540 - protein, 464 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8541 - protein, 469 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8542 - protein, 460 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8543 - protein, 456 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8544 - protein, 461 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8545 - protein, 451 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8546 - protein, 451 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8547 - protein, 455 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8548 - protein, 459 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8549 - protein, 459 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8550 - protein, 461 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8551 - protein, 461 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8552 - protein, 458 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8553 - protein, 458 aa, Artificial Sequence
  Synthetic Polypeptide
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8554 - protein, 464 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8555 - protein, 464 aa, Artificial Sequence
  Synthetic Polypeptide
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8556 - protein, 454 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8557 - protein, 454 aa, Artificial Sequence
  Synthetic Polypeptide
MALPVTALLLPLALLLHAARPQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8558 - protein, 433 aa, Artificial Sequence; identical to SEQ ID NO: 8308
  Synthetic Polypeptide

SEQ ID NO: 8559 - protein, 433 aa, Artificial Sequence; identical to SEQ ID NO: 8308
  Synthetic Polypeptide

SEQ ID NO: 8560 - protein, 436 aa, Artificial Sequence; identical to SEQ ID NO: 8310
  Synthetic Polypeptide

SEQ ID NO: 8561 - protein, 436 aa, Artificial Sequence; identical to SEQ ID NO: 8310
  Synthetic Polypeptide

SEQ ID NO: 8562 - protein, 459 aa, Artificial Sequence
  Synthetic Polypeptide
MALPVTALLLPLALLLHAARPDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8563 - protein, 459 aa, Artificial Sequence
  Synthetic Polypeptide
MALPVTALLLPLALLLHAARPQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8564 - protein, 462 aa, Artificial Sequence
  Synthetic Polypeptide
MALPVTALLLPLALLLHAARPQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8565 - protein, 462 aa, Artificial Sequence
  Synthetic Polypeptide
MALPVTALLLPLALLLHAARPQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8566 - protein, 454 aa, Artificial Sequence
  Synthetic Polypeptide
MALPVTALLLPLALLLHAARPDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8567 - protein, 454 aa, Artificial Sequence
  Synthetic Polypeptide
MALPVTALLLPLALLLHAARPQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8568 - protein, 462 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8569 - protein, 462 aa, Artificial Sequence
  Synthetic Polypeptide
MALPVTALLLPLALLLHAARPQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8570 - protein, 457 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8571 - protein, 457 aa, Artificial Sequence
  Synthetic Polypeptide
MALPVTALLLPLALLLHAARPEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8572 - protein, 454 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8573 - protein, 454 aa, Artificial Sequence
  Synthetic Polypeptide
MALPVTALLLPLALLLHAARPEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8574 - protein, 454 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8575 - protein, 454 aa, Artificial Sequence
  Synthetic Polypeptide
MALPVTALLLPLALLLHAARPEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8576 - protein, 462 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8577 - protein, 462 aa, Artificial Sequence
  Synthetic Polypeptide
MALPVTALLLPLALLLHAARPQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8578 - protein, 469 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8579 - protein, 469 aa, Artificial Sequence
  Synthetic Polypeptide
MALPVTALLLPLALLLHAARPEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVTREQKLISEEDLAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8580 - protein, 442 aa, Artificial Sequence
  Synthetic Polypeptide
MALPVTALLLPLALLLHAARPVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8581 - protein, 445 aa, Artificial Sequence
  Synthetic Polypeptide
MALPVTALLLPLALLLHAARPEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8582 - protein, 450 aa, Artificial Sequence
  Synthetic Polypeptide
MALPVTALLLPLALLLHAARPDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8583 - protein, 453 aa, Artificial Sequence
  Synthetic Polypeptide
MALPVTALLLPLALLLHAARPDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8584 - protein, 451 aa, Artificial Sequence
  Synthetic Polypeptide
MALPVTALLLPLALLLHAARPDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8585 - protein, 452 aa, Artificial Sequence
  Synthetic Polypeptide
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8586 - protein, 448 aa, Artificial Sequence
  Synthetic Polypeptide
MALPVTALLLPLALLLHAARPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8587 - protein, 450 aa, Artificial Sequence
  Synthetic Polypeptide
MALPVTALLLPLALLLHAARPSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8588 - protein, 445 aa, Artificial Sequence
  Synthetic Polypeptide
MALPVTALLLPLALLLHAARPQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSATRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8589 - protein, 446 aa, Artificial Sequence
  Synthetic Polypeptide
MALPVTALLLPLALLLHAARPDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSTRAKPTTTPAPRPPTPAPTIASQPLSLRPEACRPAAGGAVHTRGLDFACDIYIWAPLAGTCGVLLLSLVITLYCGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 8590 - skipped

SEQ ID NO: 8591 - protein, 336 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVIEVMYPPPYLDNEKSNGTIIHVKGKHLCPSPLFPGPSKPFWVLVVVGGVLACYSLLVTVAFIIFWVRSKRS

SEQ ID NO: 8592 - protein, 336 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8593 - protein, 336 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8594 - protein, 337 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8595 - protein, 344 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8596 - protein, 361 aa, Artificial Sequence
  Synthetic Polypeptide
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8597 - protein, 338 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8598 - protein, 337 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8599 - protein, 343 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8600 - protein, 348 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8601 - protein, 335 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRIEVMYPPPYLDNEKSNGTIIHVKGKHLCPSPLFPGPSKPFWVLVVVGGVLACYSLLVTVAFIIFWVRSKRS

SEQ ID NO: 8602 - protein, 345 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8603 - protein, 336 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8604 - protein, 340 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRIEVMYPPPYLDNEKSNGTIIHVKGKHLCPSPLFPGPSKPFWVLVVVGGVLACYSLLVTVAFIIFWVRSKRS

SEQ ID NO: 8605 - protein, 338 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8606 - protein, 338 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8607 - protein, 339 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8608 - protein, 337 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8609 - protein, 348 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8610 - protein, 337 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8611 - protein, 338 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8612 - protein, 339 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8613 - protein, 339 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8614 - protein, 339 aa, Artificial Sequence; identical to SEQ ID NO: 8613
  Synthetic Polypeptide

SEQ ID NO: 8615 - protein, 339 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8616 - protein, 341 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8617 - protein, 338 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8618 - protein, 341 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8619 - protein, 339 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8620 - protein, 338 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8621 - protein, 348 aa, Artificial Sequence
  Synthetic Polypeptide
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRIEVMYPPPYLDNEKSNGTIIHVKGKHLCPSPLFPGPSKPFWVLVVVGGVLACYSLLVTVAFIIFWVRSKRS

SEQ ID NO: 8622 - protein, 340 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIEVMYPPPYLDNEKSNGTIIHVKGKHLCPSPLFPGPSKPFWVLVVVGGVLACYSLLVTVAFIIFWVRSKRS

SEQ ID NO: 8623 - protein, 338 aa, Artificial Sequence; identical to SEQ ID NO: 8620
  Synthetic Polypeptide

SEQ ID NO: 8624 - protein, 337 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8625 - protein, 339 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8626 - protein, 337 aa, Artificial Sequence
  Synthetic Polypeptide
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8627 - protein, 342 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8628 - protein, 334 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8629 - protein, 340 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8630 - protein, 340 aa, Artificial Sequence
  Synthetic Polypeptide
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRIEVMYPPPYLDNEKSNGTIIHVKGKHLCPSPLFPGPSKPFWVLVVVGGVLACYSLLVTVAFIIFWVRSKRS

SEQ ID NO: 8631 - protein, 333 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8632 - protein, 338 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8633 - protein, 335 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8634 - protein, 345 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8635 - protein, 341 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8636 - protein, 367 aa, Artificial Sequence
  Synthetic Polypeptide
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRIEVMYPPPYLDNEKSNGTIIHVKGKHLCPSPLFPGPSKPFWVLVVVGGVLACYSLLVTVAFIIFWVRSKRS

SEQ ID NO: 8637 - protein, 366 aa, Artificial Sequence
  Synthetic Polypeptide
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRIEVMYPPPYLDNEKSNGTIIHVKGKHLCPSPLFPGPSKPFWVLVVVGGVLACYSLLVTVAFIIFWVRSKRS

SEQ ID NO: 8638 - protein, 382 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRIEVMYPPPYLDNEKSNGTIIHVKGKHLCPSPLFPGPSKPFWVLVVVGGVLACYSLLVTVAFIIFWVRSKRS

SEQ ID NO: 8639 - protein, 338 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8640 - protein, 337 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8641 - protein, 334 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8642 - protein, 344 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8643 - protein, 331 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8644 - protein, 339 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8645 - protein, 335 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8646 - protein, 339 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8647 - protein, 335 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8648 - protein, 343 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8649 - protein, 338 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8650 - protein, 342 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8651 - protein, 342 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8652 - protein, 336 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8653 - protein, 338 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8654 - protein, 335 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8655 - protein, 336 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8656 - protein, 332 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8657 - protein, 363 aa, Artificial Sequence
  Synthetic Polypeptide
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8658 - protein, 334 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8659 - protein, 343 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8660 - protein, 347 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8661 - protein, 338 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8662 - protein, 333 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8663 - protein, 336 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8664 - protein, 331 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRIEVMYPPPYLDNEKSNGTIIHVKGKHLCPSPLFPGPSKPFWVLVVVGGVLACYSLLVTVAFIIFWVRSKRS

SEQ ID NO: 8665 - protein, 341 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8666 - protein, 333 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8667 - protein, 336 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8668 - protein, 346 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8669 - protein, 343 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8670 - protein, 335 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRIEVMYPPPYLDNEKSNGTIIHVKGKHLCPSPLFPGPSKPFWVLVVVGGVLACYSLLVTVAFIIFWVRSKRS

SEQ ID NO: 8671 - protein, 328 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8672 - protein, 333 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8673 - protein, 336 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8674 - protein, 341 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRIEVMYPPPYLDNEKSNGTIIHVKGKHLCPSPLFPGPSKPFWVLVVVGGVLACYSLLVTVAFIIFWVRSKRS

SEQ ID NO: 8675 - protein, 336 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8676 - protein, 342 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8677 - protein, 340 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8678 - protein, 340 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8679 - protein, 338 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8680 - protein, 335 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8681 - protein, 336 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8682 - protein, 338 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8683 - protein, 339 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8684 - protein, 339 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8685 - protein, 339 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8686 - protein, 337 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRIEVMYPPPYLDNEKSNGTIIHVKGKHLCPSPLFPGPSKPFWVLVVVGGVLACYSLLVTVAFIIFWVRSKRS

SEQ ID NO: 8687 - protein, 337 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8688 - protein, 342 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8689 - protein, 342 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8690 - protein, 340 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8691 - protein, 335 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8692 - protein, 330 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8693 - protein, 336 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRIEVMYPPPYLDNEKSNGTIIHVKGKHLCPSPLFPGPSKPFWVLVVVGGVLACYSLLVTVAFIIFWVRSKRS

SEQ ID NO: 8694 - protein, 343 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8695 - protein, 344 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8696 - protein, 341 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8697 - protein, 338 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRIEVMYPPPYLDNEKSNGTIIHVKGKHLCPSPLFPGPSKPFWVLVVVGGVLACYSLLVTVAFIIFWVRSKRS

SEQ ID NO: 8698 - protein, 349 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIEVMYPPPYLDNEKSNGTIIHVKGKHLCPSPLFPGPSKPFWVLVVVGGVLACYSLLVTVAFIIFWVRSKRS

SEQ ID NO: 8699 - protein, 345 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRIEVMYPPPYLDNEKSNGTIIHVKGKHLCPSPLFPGPSKPFWVLVVVGGVLACYSLLVTVAFIIFWVRSKRS

SEQ ID NO: 8700 - protein, 339 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8701 - protein, 336 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8702 - protein, 334 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8703 - protein, 336 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8704 - protein, 338 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8705 - protein, 343 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8706 - protein, 337 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8707 - protein, 338 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8708 - protein, 337 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8709 - protein, 336 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRIEVMYPPPYLDNEKSNGTIIHVKGKHLCPSPLFPGPSKPFWVLVVVGGVLACYSLLVTVAFIIFWVRSKRS

SEQ ID NO: 8710 - protein, 336 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8711 - protein, 338 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8712 - protein, 336 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRIEVMYPPPYLDNEKSNGTIIHVKGKHLCPSPLFPGPSKPFWVLVVVGGVLACYSLLVTVAFIIFWVRSKRS

SEQ ID NO: 8713 - protein, 335 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8714 - protein, 335 aa, Artificial Sequence
  Synthetic Polypeptide
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8715 - protein, 343 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRIEVMYPPPYLDNEKSNGTIIHVKGKHLCPSPLFPGPSKPFWVLVVVGGVLACYSLLVTVAFIIFWVRSKRS

SEQ ID NO: 8716 - protein, 349 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8717 - protein, 334 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRIEVMYPPPYLDNEKSNGTIIHVKGKHLCPSPLFPGPSKPFWVLVVVGGVLACYSLLVTVAFIIFWVRSKRS

SEQ ID NO: 8718 - protein, 344 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8719 - protein, 340 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8720 - protein, 324 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8721 - protein, 334 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8722 - protein, 338 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8723 - protein, 334 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRIEVMYPPPYLDNEKSNGTIIHVKGKHLCPSPLFPGPSKPFWVLVVVGGVLACYSLLVTVAFIIFWVRSKRS

SEQ ID NO: 8724 - protein, 335 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8725 - protein, 340 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRIEVMYPPPYLDNEKSNGTIIHVKGKHLCPSPLFPGPSKPFWVLVVVGGVLACYSLLVTVAFIIFWVRSKRS

SEQ ID NO: 8726 - protein, 334 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8727 - protein, 335 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRIEVMYPPPYLDNEKSNGTIIHVKGKHLCPSPLFPGPSKPFWVLVVVGGVLACYSLLVTVAFIIFWVRSKRS

SEQ ID NO: 8728 - protein, 343 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRIEVMYPPPYLDNEKSNGTIIHVKGKHLCPSPLFPGPSKPFWVLVVVGGVLACYSLLVTVAFIIFWVRSKRS

SEQ ID NO: 8729 - protein, 339 aa, Artificial Sequence; identical to SEQ ID NO: 8646
  Synthetic Polypeptide

SEQ ID NO: 8730 - protein, 336 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8731 - protein, 336 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8732 - protein, 335 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8733 - protein, 334 aa, Artificial Sequence
  Synthetic Polypeptide
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRIEVMYPPPYLDNEKSNGTIIHVKGKHLCPSPLFPGPSKPFWVLVVVGGVLACYSLLVTVAFIIFWVRSKRS

SEQ ID NO: 8734 - protein, 335 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8735 - protein, 339 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8736 - protein, 342 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8737 - protein, 344 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8738 - protein, 343 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8739 - protein, 333 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8740 - protein, 335 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8741 - protein, 335 aa, Artificial Sequence
  Synthetic Polypeptide
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8742 - protein, 336 aa, Artificial Sequence
  Synthetic Polypeptide
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8743 - protein, 334 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8744 - protein, 353 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8745 - protein, 350 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8746 - protein, 324 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRIEVMYPPPYLDNEKSNGTIIHVKGKHLCPSPLFPGPSKPFWVLVVVGGVLACYSLLVTVAFIIFWVRSKRS

SEQ ID NO: 8747 - protein, 340 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8748 - protein, 331 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRIEVMYPPPYLDNEKSNGTIIHVKGKHLCPSPLFPGPSKPFWVLVVVGGVLACYSLLVTVAFIIFWVRSKRS

SEQ ID NO: 8749 - protein, 332 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8750 - protein, 332 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRIEVMYPPPYLDNEKSNGTIIHVKGKHLCPSPLFPGPSKPFWVLVVVGGVLACYSLLVTVAFIIFWVRSKRS

SEQ ID NO: 8751 - protein, 343 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8752 - protein, 339 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8753 - protein, 334 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8754 - protein, 338 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8755 - protein, 347 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8756 - protein, 338 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8757 - protein, 341 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8758 - protein, 336 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRIEVMYPPPYLDNEKSNGTIIHVKGKHLCPSPLFPGPSKPFWVLVVVGGVLACYSLLVTVAFIIFWVRSKRS

SEQ ID NO: 8759 - protein, 337 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8760 - protein, 334 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRIEVMYPPPYLDNEKSNGTIIHVKGKHLCPSPLFPGPSKPFWVLVVVGGVLACYSLLVTVAFIIFWVRSKRS

SEQ ID NO: 8761 - protein, 346 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8762 - protein, 336 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8763 - protein, 333 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8764 - protein, 338 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRIEVMYPPPYLDNEKSNGTIIHVKGKHLCPSPLFPGPSKPFWVLVVVGGVLACYSLLVTVAFIIFWVRSKRS

SEQ ID NO: 8765 - protein, 337 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8766 - protein, 339 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8767 - protein, 335 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8768 - protein, 333 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8769 - protein, 344 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8770 - protein, 339 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8771 - protein, 340 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8772 - protein, 340 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8773 - protein, 352 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8774 - protein, 346 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8775 - protein, 336 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRIEVMYPPPYLDNEKSNGTIIHVKGKHLCPSPLFPGPSKPFWVLVVVGGVLACYSLLVTVAFIIFWVRSKRS

SEQ ID NO: 8776 - protein, 335 aa, Artificial Sequence
  Synthetic Polypeptide
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8777 - protein, 337 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8778 - protein, 328 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8779 - protein, 331 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8780 - protein, 338 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8781 - protein, 334 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8782 - protein, 335 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8783 - protein, 336 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8784 - protein, 341 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8785 - protein, 348 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8786 - protein, 342 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8787 - protein, 347 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8788 - protein, 344 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8789 - protein, 349 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8790 - protein, 354 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8791 - protein, 359 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8792 - protein, 350 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8793 - protein, 346 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8794 - protein, 351 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8795 - protein, 341 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8796 - protein, 341 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8797 - protein, 345 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8798 - protein, 349 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8799 - protein, 349 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8800 - protein, 351 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8801 - protein, 351 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8802 - protein, 348 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8803 - protein, 348 aa, Artificial Sequence
  Synthetic Polypeptide
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8804 - protein, 354 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8805 - protein, 354 aa, Artificial Sequence
  Synthetic Polypeptide
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8806 - protein, 344 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8807 - protein, 344 aa, Artificial Sequence
  Synthetic Polypeptide
MALPVTALLLPLALLLHAARPQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8808 - protein, 327 aa, Artificial Sequence
  Synthetic Polypeptide
MALPVTALLLPLALLLHAARPEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQYAAETDLGRGSDSYVSSSLPRQEEQWNHYPCERETPLSKSPISRTFALLGAGGGWGSPGLLLASNSGLYYFLGEEEEL

SEQ ID NO: 8809 - protein, 327 aa, Artificial Sequence; identical to SEQ ID NO: 8808
  Synthetic Polypeptide

SEQ ID NO: 8810 - protein, 330 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQYAAETDLGRGSDSYVSSSLPRQEEQWNHYPCERETPLSKSPISRTFALLGAGGGWGSPGLLLASNSGLYYFLGEEEEL

SEQ ID NO: 8811 - protein, 330 aa, Artificial Sequence; identical to SEQ ID NO: 8810
  Synthetic Polypeptide

SEQ ID NO: 8812 - protein, 349 aa, Artificial Sequence
  Synthetic Polypeptide
MALPVTALLLPLALLLHAARPDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8813 - protein, 349 aa, Artificial Sequence
  Synthetic Polypeptide
MALPVTALLLPLALLLHAARPQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8814 - protein, 352 aa, Artificial Sequence
  Synthetic Polypeptide
MALPVTALLLPLALLLHAARPQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8815 - protein, 352 aa, Artificial Sequence
  Synthetic Polypeptide
MALPVTALLLPLALLLHAARPQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8816 - protein, 344 aa, Artificial Sequence
  Synthetic Polypeptide
MALPVTALLLPLALLLHAARPDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8817 - protein, 344 aa, Artificial Sequence
  Synthetic Polypeptide
MALPVTALLLPLALLLHAARPQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8818 - protein, 352 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8819 - protein, 352 aa, Artificial Sequence
  Synthetic Polypeptide
MALPVTALLLPLALLLHAARPQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8820 - protein, 347 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8821 - protein, 347 aa, Artificial Sequence
  Synthetic Polypeptide
MALPVTALLLPLALLLHAARPEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8822 - protein, 344 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8823 - protein, 344 aa, Artificial Sequence
  Synthetic Polypeptide
MALPVTALLLPLALLLHAARPEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8824 - protein, 344 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8825 - protein, 344 aa, Artificial Sequence
  Synthetic Polypeptide
MALPVTALLLPLALLLHAARPEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8826 - protein, 352 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8827 - protein, 352 aa, Artificial Sequence
  Synthetic Polypeptide
MALPVTALLLPLALLLHAARPQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8828 - protein, 359 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8829 - protein, 359 aa, Artificial Sequence
  Synthetic Polypeptide
MALPVTALLLPLALLLHAARPEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVTREQKLISEEDLIEVMYPPPYLDNEKSNGTIIHVKGKHLCPSPLFPGPSKPFWVLVVVGGVLACYSLLVTVAFIIFWVRSKRS

SEQ ID NO: 8830 - protein, 332 aa, Artificial Sequence
  Synthetic Polypeptide
MALPVTALLLPLALLLHAARPVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSTRIEVMYPPPYLDNEKSNGTIIHVKGKHLCPSPLFPGPSKPFWVLVVVGGVLACYSLLVTVAFIIFWVRSKRS

SEQ ID NO: 8831 - protein, 335 aa, Artificial Sequence
  Synthetic Polypeptide
MALPVTALLLPLALLLHAARPEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8832 - protein, 340 aa, Artificial Sequence
  Synthetic Polypeptide
MALPVTALLLPLALLLHAARPDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8833 - protein, 343 aa, Artificial Sequence
  Synthetic Polypeptide
MALPVTALLLPLALLLHAARPDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8834 - protein, 341 aa, Artificial Sequence
  Synthetic Polypeptide
MALPVTALLLPLALLLHAARPDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSTRIEVMYPPPYLDNEKSNGTIIHVKGKHLCPSPLFPGPSKPFWVLVVVGGVLACYSLLVTVAFIIFWVRSKRS

SEQ ID NO: 8835 - protein, 342 aa, Artificial Sequence
  Synthetic Polypeptide
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8836 - protein, 338 aa, Artificial Sequence
  Synthetic Polypeptide
MALPVTALLLPLALLLHAARPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSTRIEVMYPPPYLDNEKSNGTIIHVKGKHLCPSPLFPGPSKPFWVLVVVGGVLACYSLLVTVAFIIFWVRSKRS

SEQ ID NO: 8837 - protein, 340 aa, Artificial Sequence
  Synthetic Polypeptide
MALPVTALLLPLALLLHAARPSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKTRIEVMYPPPYLDNEKSNGTIIHVKGKHLCPSPLFPGPSKPFWVLVVVGGVLACYSLLVTVAFIIFWVRSKRS

SEQ ID NO: 8838 - protein, 335 aa, Artificial Sequence
  Synthetic Polypeptide
MALPVTALLLPLALLLHAARPQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSATRIEVMYPPPYLDNEKSNGTIIHVKGKHLCPSPLFPGPSKPFWVLVVVGGVLACYSLLVTVAFIIFWVRSKRS

SEQ ID NO: 8839 - protein, 336 aa, Artificial Sequence
  Synthetic Polypeptide
MALPVTALLLPLALLLHAARPDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSTRIEVMYPPPYLDNEKSNGTIIHVKGKHLCPSPLFPGPSKPFWVLVVVGGVLACYSLLVTVAFIIFWVRSKRS

SEQ ID NO: 8840 - skipped

SEQ ID NO: 8841 - protein, 445 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8842 - protein, 445 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8843 - protein, 445 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8844 - protein, 446 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8845 - protein, 453 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8846 - protein, 470 aa, Artificial Sequence
  Synthetic Polypeptide
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8847 - protein, 447 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8848 - protein, 446 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8849 - protein, 452 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8850 - protein, 457 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8851 - protein, 444 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8852 - protein, 454 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8853 - protein, 445 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8854 - protein, 449 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8855 - protein, 447 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8856 - protein, 447 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8857 - protein, 448 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8858 - protein, 446 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8859 - protein, 457 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8860 - protein, 446 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8861 - protein, 447 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8862 - protein, 448 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8863 - protein, 448 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8864 - protein, 448 aa, Artificial Sequence; identical to SEQ ID NO: 8863
  Synthetic Polypeptide

SEQ ID NO: 8865 - protein, 448 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8866 - protein, 450 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8867 - protein, 447 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8868 - protein, 450 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8869 - protein, 448 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8870 - protein, 447 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8871 - protein, 457 aa, Artificial Sequence
  Synthetic Polypeptide
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8872 - protein, 449 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8873 - protein, 447 aa, Artificial Sequence; identical to SEQ ID NO: 8870
  Synthetic Polypeptide

SEQ ID NO: 8874 - protein, 446 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8875 - protein, 448 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8876 - protein, 446 aa, Artificial Sequence
  Synthetic Polypeptide
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8877 - protein, 451 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8878 - protein, 443 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8879 - protein, 449 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8880 - protein, 449 aa, Artificial Sequence
  Synthetic Polypeptide
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8881 - protein, 442 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8882 - protein, 447 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8883 - protein, 444 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8884 - protein, 454 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8885 - protein, 450 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8886 - protein, 476 aa, Artificial Sequence
  Synthetic Polypeptide
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8887 - protein, 475 aa, Artificial Sequence
  Synthetic Polypeptide
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8888 - protein, 491 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8889 - protein, 447 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8890 - protein, 446 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8891 - protein, 443 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8892 - protein, 453 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8893 - protein, 440 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8894 - protein, 448 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8895 - protein, 444 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8896 - protein, 448 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8897 - protein, 444 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8898 - protein, 452 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8899 - protein, 447 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8900 - protein, 451 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8901 - protein, 451 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8902 - protein, 445 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8903 - protein, 447 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8904 - protein, 444 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8905 - protein, 445 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8906 - protein, 441 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8907 - protein, 472 aa, Artificial Sequence
  Synthetic Polypeptide
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8908 - protein, 443 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8909 - protein, 452 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8910 - protein, 456 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8911 - protein, 447 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8912 - protein, 442 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8913 - protein, 445 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8914 - protein, 440 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8915 - protein, 450 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8916 - protein, 442 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8917 - protein, 445 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8918 - protein, 455 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8919 - protein, 452 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8920 - protein, 444 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8921 - protein, 437 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8922 - protein, 442 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8923 - protein, 445 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8924 - protein, 450 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8925 - protein, 445 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8926 - protein, 451 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8927 - protein, 449 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8928 - protein, 449 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8929 - protein, 447 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8930 - protein, 444 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8931 - protein, 445 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8932 - protein, 447 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8933 - protein, 448 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8934 - protein, 448 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8935 - protein, 448 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8936 - protein, 446 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8937 - protein, 446 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8938 - protein, 451 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8939 - protein, 451 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8940 - protein, 449 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8941 - protein, 444 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8942 - protein, 439 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8943 - protein, 445 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8944 - protein, 452 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8945 - protein, 453 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8946 - protein, 450 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8947 - protein, 447 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8948 - protein, 458 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8949 - protein, 454 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8950 - protein, 448 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8951 - protein, 445 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8952 - protein, 443 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8953 - protein, 445 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8954 - protein, 447 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8955 - protein, 452 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8956 - protein, 446 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8957 - protein, 447 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8958 - protein, 446 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8959 - protein, 445 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8960 - protein, 445 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8961 - protein, 447 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8962 - protein, 445 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8963 - protein, 444 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8964 - protein, 444 aa, Artificial Sequence
  Synthetic Polypeptide
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8965 - protein, 452 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8966 - protein, 458 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8967 - protein, 443 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8968 - protein, 453 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8969 - protein, 449 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8970 - protein, 433 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8971 - protein, 443 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8972 - protein, 447 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8973 - protein, 443 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8974 - protein, 444 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8975 - protein, 449 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8976 - protein, 443 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8977 - protein, 444 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8978 - protein, 452 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8979 - protein, 448 aa, Artificial Sequence; identical to SEQ ID NO: 8896
  Synthetic Polypeptide

SEQ ID NO: 8980 - protein, 445 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8981 - protein, 445 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8982 - protein, 444 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8983 - protein, 443 aa, Artificial Sequence
  Synthetic Polypeptide
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8984 - protein, 444 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8985 - protein, 448 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8986 - protein, 451 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8987 - protein, 453 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8988 - protein, 452 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8989 - protein, 442 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8990 - protein, 444 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8991 - protein, 444 aa, Artificial Sequence
  Synthetic Polypeptide
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8992 - protein, 445 aa, Artificial Sequence
  Synthetic Polypeptide
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8993 - protein, 443 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8994 - protein, 462 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8995 - protein, 459 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8996 - protein, 433 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8997 - protein, 449 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8998 - protein, 440 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 8999 - protein, 441 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9000 - protein, 441 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9001 - protein, 452 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9002 - protein, 448 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9003 - protein, 443 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9004 - protein, 447 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9005 - protein, 456 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9006 - protein, 447 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9007 - protein, 450 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9008 - protein, 445 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9009 - protein, 446 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9010 - protein, 443 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9011 - protein, 455 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9012 - protein, 445 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9013 - protein, 442 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9014 - protein, 447 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9015 - protein, 446 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9016 - protein, 448 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9017 - protein, 444 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9018 - protein, 442 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9019 - protein, 453 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9020 - protein, 448 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9021 - protein, 449 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9022 - protein, 449 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9023 - protein, 461 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9024 - protein, 455 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9025 - protein, 445 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9026 - protein, 444 aa, Artificial Sequence
  Synthetic Polypeptide
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9027 - protein, 446 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9028 - protein, 437 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9029 - protein, 440 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9030 - protein, 447 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9031 - protein, 443 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9032 - protein, 444 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9033 - protein, 445 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9034 - protein, 450 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9035 - protein, 457 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9036 - protein, 451 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9037 - protein, 456 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9038 - protein, 453 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9039 - protein, 458 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9040 - protein, 463 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9041 - protein, 468 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9042 - protein, 459 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9043 - protein, 455 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9044 - protein, 460 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9045 - protein, 450 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9046 - protein, 450 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9047 - protein, 454 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9048 - protein, 458 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9049 - protein, 458 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9050 - protein, 460 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9051 - protein, 460 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9052 - protein, 457 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9053 - protein, 457 aa, Artificial Sequence
  Synthetic Polypeptide
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9054 - protein, 463 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9055 - protein, 463 aa, Artificial Sequence
  Synthetic Polypeptide
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9056 - protein, 453 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9057 - protein, 453 aa, Artificial Sequence
  Synthetic Polypeptide
MALPVTALLLPLALLLHAARPQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9058 - protein, 428 aa, Artificial Sequence
  Synthetic Polypeptide
MALPVTALLLPLALLLHAARPEIVLTQSPGTLSLSPGERATLSCRASQSVSSDYLAWYQQKPGQAPRLLIYGASSRATGIPDRFSGSGSGTDFTLTISRLPEDFAVYYCQQYVSYWTFGGGTKVEIKRTVAEAEVEAEDLAAEALRSCHRALAHCHCLQAKEPHAVEPARACPAITWLGISRSPDRLPDCSTVPLAEPQASPIDFLAAAPAPTSPQLADCPRTSPCTTASSTCPTGPLAEAPRWKSKEQYAAETDLGRGSDSYVSSSLPRQEEQWNHYPCERETPLSKSPISRTFALLGAGGGWGSPGLLLASNSGLYYFLGEEEERRRRPSRNHSRRWQNISKGTNMCRPLYRHVGGRQKGGQRSQTFQIHVGKTRSHGMGGGRGSNVRRPTRAHHQPRLRIRRYRTSRNYSPSRYLGVRRTVEARM

SEQ ID NO: 9059 - protein, 428 aa, Artificial Sequence; identical to SEQ ID NO: 9058
  Synthetic Polypeptide

SEQ ID NO: 9060 - protein, 431 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYHHSPLTFGGGTKVEIKRTVAEAEVEAEDLAAEALRSCHRALAHCHCLQAKEPHAVEPARACPALTWLGISRSPDRLPDCSTVPLAEPQASPIDFLAAAPAPTSPQSADWNPRTSPCTTASSTTTLHPLAEAPRWKSREQYAAETDLGRGSDSYVSSSLPRQEEQWNHYPCERETPLSKSPISRTFALLGAGGGWGSPGLLLASNSGLYYFLGEEEERRRRPSRNHSRRWQNISKGTNMCRPLYRHVGGRQKGGQRSQTFQIHVGKTRSHGMGGGRGSNVRRPTRAHHQPRLRIRRYRTSRNYSPSRYLGVRRTVEARM

SEQ ID NO: 9061 - protein, 431 aa, Artificial Sequence; identical to SEQ ID NO: 9060
  Synthetic Polypeptide

SEQ ID NO: 9062 - protein, 458 aa, Artificial Sequence
  Synthetic Polypeptide
MALPVTALLLPLALLLHAARPDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9063 - protein, 458 aa, Artificial Sequence
  Synthetic Polypeptide
MALPVTALLLPLALLLHAARPQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9064 - protein, 461 aa, Artificial Sequence
  Synthetic Polypeptide
MALPVTALLLPLALLLHAARPQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9065 - protein, 461 aa, Artificial Sequence
  Synthetic Polypeptide
MALPVTALLLPLALLLHAARPQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9066 - protein, 453 aa, Artificial Sequence
  Synthetic Polypeptide
MALPVTALLLPLALLLHAARPDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9067 - protein, 453 aa, Artificial Sequence
  Synthetic Polypeptide
MALPVTALLLPLALLLHAARPQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9068 - protein, 461 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9069 - protein, 461 aa, Artificial Sequence
  Synthetic Polypeptide
MALPVTALLLPLALLLHAARPQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9070 - protein, 456 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9071 - protein, 456 aa, Artificial Sequence
  Synthetic Polypeptide
MALPVTALLLPLALLLHAARPEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9072 - protein, 453 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9073 - protein, 453 aa, Artificial Sequence
  Synthetic Polypeptide
MALPVTALLLPLALLLHAARPEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9074 - protein, 453 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9075 - protein, 453 aa, Artificial Sequence
  Synthetic Polypeptide
MALPVTALLLPLALLLHAARPEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9076 - protein, 461 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9077 - protein, 461 aa, Artificial Sequence
  Synthetic Polypeptide
MALPVTALLLPLALLLHAARPQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9078 - protein, 468 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9079 - protein, 468 aa, Artificial Sequence
  Synthetic Polypeptide
MALPVTALLLPLALLLHAARPEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9080 - protein, 441 aa, Artificial Sequence
  Synthetic Polypeptide
MALPVTALLLPLALLLHAARPVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9081 - protein, 444 aa, Artificial Sequence
  Synthetic Polypeptide
MALPVTALLLPLALLLHAARPEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9082 - protein, 449 aa, Artificial Sequence
  Synthetic Polypeptide
MALPVTALLLPLALLLHAARPDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9083 - protein, 452 aa, Artificial Sequence
  Synthetic Polypeptide
MALPVTALLLPLALLLHAARPDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9084 - protein, 450 aa, Artificial Sequence
  Synthetic Polypeptide
MALPVTALLLPLALLLHAARPDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9085 - protein, 451 aa, Artificial Sequence
  Synthetic Polypeptide
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9086 - protein, 447 aa, Artificial Sequence
  Synthetic Polypeptide
MALPVTALLLPLALLLHAARPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9087 - protein, 449 aa, Artificial Sequence
  Synthetic Polypeptide
MALPVTALLLPLALLLHAARPSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9088 - protein, 444 aa, Artificial Sequence
  Synthetic Polypeptide
MALPVTALLLPLALLLHAARPQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9089 - protein, 445 aa, Artificial Sequence
  Synthetic Polypeptide
MALPVTALLLPLALLLHAARPDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 9090 - skipped

SEQ ID NO: 9091 - protein, 445 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9092 - protein, 445 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9093 - protein, 445 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKGGGGSGGGGSGGGGSQVQLQESGPGLVKPSETLSLTCTVSGVSLPDYGVSWIRQPPGKGLEWIGVIWGSETTYYQSSLKSRVTISKDNSKNQVSLKLSSVTAADTAVYYCAKHYYYGGSYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9094 - protein, 446 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRGGGGSGGGGSGGGGSQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9095 - protein, 453 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9096 - protein, 470 aa, Artificial Sequence
  Synthetic Polypeptide
MALPVTALLLPLALLLHAARPINIYNAEPANPSEKNSPEFDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKGGGGSGGGGSGGGGSEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9097 - protein, 447 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9098 - protein, 446 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGGGGGSGGGGSGGGGSEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9099 - protein, 452 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLGGGGSGGGGSGGGGSEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9100 - protein, 457 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGGGGGSGGGGSGGGGSQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9101 - protein, 444 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKGGGGSGGGGSGGGGSRAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9102 - protein, 454 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKGGGGSGGGGSGGGGSGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9103 - protein, 445 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINGGGGSGGGGSGGGGSALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9104 - protein, 449 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9105 - protein, 447 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRGGGGSGGGGSGGGGSQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9106 - protein, 447 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRGGGGSGGGGSGGGGSQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9107 - protein, 448 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGGGGGSGGGGSGGGGSQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9108 - protein, 446 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGGGGGSGGGGSGGGGSEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9109 - protein, 457 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRGGGGSGGGGSGGGGSLEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9110 - protein, 446 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKGGGGSGGGGSGGGGSQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9111 - protein, 447 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRGGGGSGGGGSGGGGSQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9112 - protein, 448 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKGGGGSGGGGSGGGGSQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9113 - protein, 448 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRGGGGSGGGGSGGGGSQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9114 - protein, 448 aa, Artificial Sequence; identical to SEQ ID NO: 9113
  Synthetic Polypeptide

SEQ ID NO: 9115 - protein, 448 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9116 - protein, 450 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRGGGGSGGGGSGGGGSQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9117 - protein, 447 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRGGGGSGGGGSGGGGSEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9118 - protein, 450 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKGGGGSGGGGSGGGGSEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9119 - protein, 448 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKGGGGSGGGGSGGGGSAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9120 - protein, 447 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRGGGGSGGGGSGGGGSEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9121 - protein, 457 aa, Artificial Sequence
  Synthetic Polypeptide
MALPVTALLLPLALLLHAARPSTVMTQSPDSLAVSLGERATINCKSSQSNSNDVAWYQQKPGQSPKVLIYFASNRYSGVPDRFSGSGYGTDFTLTISSLQAEDVAVYFCQQDYSSPLTFGAGTKLELKRADAGGGGSGGGGSGGGGSQIQLVQSGSELKKPGASVKVSCKASGYTFTNFGVNWVRQAPGKGLEWMGWINTYTGEPSYAQGFTGRFVFSLDASVSTAYLQISSLKAEDTATYFCTRRTNYYGTSYYYAMDYWGQGTTVTVSSAKTTTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9122 - protein, 449 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAGGGGSGGGGSGGGGSQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9123 - protein, 447 aa, Artificial Sequence; identical to SEQ ID NO: 9120
  Synthetic Polypeptide

SEQ ID NO: 9124 - protein, 446 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKGGGGSGGGGSGGGGSQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9125 - protein, 448 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKGGGGSGGGGSGGGGSEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9126 - protein, 446 aa, Artificial Sequence
  Synthetic Polypeptide
MALPVTALLLPLALLLHAARPEIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLELKRGGGGSGGGGSGGGGSEVQLVQSGAEVKKPGESLKLSCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9127 - protein, 451 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9128 - protein, 443 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRGGGGSGGGGSGGGGSQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9129 - protein, 449 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKGGGGSGGGGSGGGGSQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9130 - protein, 449 aa, Artificial Sequence
  Synthetic Polypeptide
MALPVTALLLPLALLLHAARPQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSGGGGSGGGGSGGGGSDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9131 - protein, 442 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKGGGGSGGGGSGGGGSQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9132 - protein, 447 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKGGGGSGGGGSGGGGSQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9133 - protein, 444 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9134 - protein, 454 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKGGGGSGGGGSGGGGSQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9135 - protein, 450 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRGGGGSGGGGSGGGGSQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9136 - protein, 476 aa, Artificial Sequence
  Synthetic Polypeptide
MALPVTALLLPLALLLHAARPYINIYNAEPANPSEKNSPTQYAYGSGEFDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAAGGGGSGGGGSGGGGSQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9137 - protein, 475 aa, Artificial Sequence
  Synthetic Polypeptide
MALPVTALLLPLALLLHAARPYINIYNAEPANPSEKNSPTQYAYGSGEFDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRGGGGSGGGGSGGGGSEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9138 - protein, 491 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKGGGGSGGGGSGGGGSQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSAKPTTTPAPRPPTPAPTIASQPLSLRPEACRPAAGGAVHTRGLDFACDITRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9139 - protein, 447 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKGGGGSGGGGSGGGGSQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9140 - protein, 446 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKGGGGSGGGGSGGGGSEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9141 - protein, 443 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKGGGGSGGGGSGGGGSEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9142 - protein, 453 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRGGGGSGGGGSGGGGSQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9143 - protein, 440 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKGGGGSGGGGSGGGGSFEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9144 - protein, 448 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRGGGGSGGGGSGGGGSQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9145 - protein, 444 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGGGGGSGGGGSGGGGSQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9146 - protein, 448 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRGGGGSGGGGSGGGGSEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9147 - protein, 444 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKGGGGSGGGGSGGGGSQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9148 - protein, 452 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRGGGGSGGGGSGGGGSEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9149 - protein, 447 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9150 - protein, 451 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9151 - protein, 451 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKGGGGSGGGGSGGGGSQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9152 - protein, 445 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRGGGGSGGGGSGGGGSEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9153 - protein, 447 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLGGGGSGGGGSGGGGSQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9154 - protein, 444 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKGGGGSGGGGSGGGGSQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9155 - protein, 445 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRGGGGSGGGGSGGGGSEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9156 - protein, 441 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9157 - protein, 472 aa, Artificial Sequence
  Synthetic Polypeptide
MALPVTALLLPLALLLHAARPYINIYNAEPANPSEKNSPTQYAYGSGEFDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKGGGGSGGGGSGGGGSQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9158 - protein, 443 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKGGGGSGGGGSGGGGSEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9159 - protein, 452 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKGGGGSGGGGSGGGGSEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9160 - protein, 456 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKGGGGSGGGGSGGGGSQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9161 - protein, 447 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKGGGGSGGGGSGGGGSQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9162 - protein, 442 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKGGGGSGGGGSGGGGSEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9163 - protein, 445 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRGGGGSGGGGSGGGGSQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9164 - protein, 440 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKGGGGSGGGGSGGGGSDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9165 - protein, 450 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKGGGGSGGGGSGGGGSEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9166 - protein, 442 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRGGGGSGGGGSGGGGSQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9167 - protein, 445 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRGGGGSGGGGSGGGGSQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9168 - protein, 455 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRGGGGSGGGGSGGGGSEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9169 - protein, 452 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRGGGGSGGGGSGGGGSQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9170 - protein, 444 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGGGSGGGGSGGGGSQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9171 - protein, 437 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRGGGGSGGGGSGGGGSESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9172 - protein, 442 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKGGGGSGGGGSGGGGSQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9173 - protein, 445 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKGGGGSGGGGSGGGGSEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9174 - protein, 450 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKGGGGSGGGGSGGGGSEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9175 - protein, 445 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKGGGGSGGGGSGGGGSEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9176 - protein, 451 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9177 - protein, 449 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKGGGGSGGGGSGGGGSQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9178 - protein, 449 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKGGGGSGGGGSGGGGSEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9179 - protein, 447 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9180 - protein, 444 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9181 - protein, 445 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9182 - protein, 447 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRGGGGSGGGGSGGGGSQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9183 - protein, 448 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKGGGGSGGGGSGGGGSEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9184 - protein, 448 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9185 - protein, 448 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKGGGGSGGGGSGGGGSEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9186 - protein, 446 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9187 - protein, 446 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKGGGGSGGGGSGGGGSQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9188 - protein, 451 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9189 - protein, 451 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGAGGGGSGGGGSGGGGSQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9190 - protein, 449 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRGGGGSGGGGSGGGGSQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9191 - protein, 444 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRGGGGSGGGGSGGGGSQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9192 - protein, 439 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVEGGGGSGGGGSGGGGSEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9193 - protein, 445 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSGGGGSGGGGSGGGGSDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9194 - protein, 452 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9195 - protein, 453 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQGGGGSGGGGSGGGGSEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9196 - protein, 450 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKGGGGSGGGGSGGGGSVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9197 - protein, 447 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKGGGGSGGGGSGGGGSEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9198 - protein, 458 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKSSADDAKKDAAKKDDAKKDDAKKDGGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9199 - protein, 454 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSGGGGSGGGGSGGGGSSVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9200 - protein, 448 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRGGGGSGGGGSGGGGSQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9201 - protein, 445 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKGGGGSGGGGSGGGGSEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9202 - protein, 443 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRGGGGSGGGGSGGGGSQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9203 - protein, 445 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRGGGGSGGGGSGGGGSEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9204 - protein, 447 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTGGGGSGGGGSGGGGSEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9205 - protein, 452 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTGGGGSGGGGSGGGGSQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9206 - protein, 446 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9207 - protein, 447 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKGGGGSGGGGSGGGGSEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9208 - protein, 446 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGGGGGSGGGGSGGGGSEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9209 - protein, 445 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGGGGGSGGGGSGGGGSEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9210 - protein, 445 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGGGGGSGGGGSGGGGSEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9211 - protein, 447 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGGGGGSGGGGSGGGGSEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9212 - protein, 445 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKGGGGSGGGGSGGGGSQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9213 - protein, 444 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRGGGGSGGGGSGGGGSQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9214 - protein, 444 aa, Artificial Sequence
  Synthetic Polypeptide
MALPVTALLLPLALLLHAARPDQSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSGGGGSGGGGSGGGGSEVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9215 - protein, 452 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPGGGGSGGGGSGGGGSQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9216 - protein, 458 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGGGGSGGGGSGGGGSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9217 - protein, 443 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9218 - protein, 453 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIGGGGSGGGGSGGGGSLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9219 - protein, 449 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRGGGGSGGGGSGGGGSQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9220 - protein, 433 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKGGGGSGGGGSGGGGSEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9221 - protein, 443 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRGGGGSGGGGSGGGGSEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9222 - protein, 447 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKGGGGSGGGGSGGGGSEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9223 - protein, 443 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRGGGGSGGGGSGGGGSQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9224 - protein, 444 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKGGGGSGGGGSGGGGSQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9225 - protein, 449 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITGGGGSGGGGSGGGGSEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9226 - protein, 443 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRGGGGSGGGGSGGGGSEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9227 - protein, 444 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRGGGGSGGGGSGGGGSQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9228 - protein, 452 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKGGGGSGGGGSGGGGSEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9229 - protein, 448 aa, Artificial Sequence; identical to SEQ ID NO: 9146
  Synthetic Polypeptide

SEQ ID NO: 9230 - protein, 445 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRGGGGSGGGGSGGGGSQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9231 - protein, 445 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKGGGGSGGGGSGGGGSEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9232 - protein, 444 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINGGGGSGGGGSGGGGSDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9233 - protein, 443 aa, Artificial Sequence
  Synthetic Polypeptide
MALPVTALLLPLALLLHAARPDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSGGGGSGGGGSGGGGSDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9234 - protein, 444 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRGGGGSGGGGSGGGGSDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9235 - protein, 448 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9236 - protein, 451 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRGGGGSGGGGSGGGGSEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9237 - protein, 453 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRGGGGSGGGGSGGGGSVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9238 - protein, 452 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQIGGGGSGGGGSGGGGSQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9239 - protein, 442 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRGGGGSGGGGSGGGGSQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9240 - protein, 444 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKGGGGSGGGGSGGGGSVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9241 - protein, 444 aa, Artificial Sequence
  Synthetic Polypeptide
MALPVTALLLPLALLLHAARPDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRGGGGSGGGGSGGGGSEVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9242 - protein, 445 aa, Artificial Sequence
  Synthetic Polypeptide
MALPVTALLLPLALLLHAARPAIVMTQTPSPVSAAVGGTVTINCQASESVYSNNYLSWFQQKPGQPPKLLIYLASTLASGVPSRFKGSGSGTQFTLTISGVQCDDAATYYCIGGKSSSTDGNAFGGGTEVVVRGGGGSGGGGSGGGGSQSLEESGGRLVKPDETLTITCTVSGIDLSSNGLTWVRQAPGEGLEWIGTINKDASAYYASWAKGRLTISKPSSTKVDLKITSPTTEDTATYFCGRIAFKTGTSIWGPGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9243 - protein, 443 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9244 - protein, 462 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRGGGGSGGGGSGGGGSGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9245 - protein, 459 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRGGGGSGGGGSGGGGSVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9246 - protein, 433 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9247 - protein, 449 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKGGGGSGGGGSGGGGSQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9248 - protein, 440 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGGGGSGGGGSGGGGSEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9249 - protein, 441 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRGGGGSGGGGSGGGGSQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9250 - protein, 441 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRGGGGSGGGGSGGGGSQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9251 - protein, 452 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKGGGGSGGGGSGGGGSQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9252 - protein, 448 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLGGGGSGGGGSGGGGSQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9253 - protein, 443 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKGGGGSGGGGSGGGGSQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9254 - protein, 447 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRGGGGSGGGGSGGGGSQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9255 - protein, 456 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRGGGGSGGGGSGGGGSEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9256 - protein, 447 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQGGGGSGGGGSGGGGSQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9257 - protein, 450 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQGGGGSGGGGSGGGGSEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9258 - protein, 445 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRGGGGSGGGGSGGGGSEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9259 - protein, 446 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKGGGGSGGGGSGGGGSQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9260 - protein, 443 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKGGGGSGGGGSGGGGSQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9261 - protein, 455 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRGGGGSGGGGSGGGGSQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9262 - protein, 445 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKGGGGSGGGGSGGGGSQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9263 - protein, 442 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRGGGGSGGGGSGGGGSQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9264 - protein, 447 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKGGGGSGGGGSGGGGSQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9265 - protein, 446 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKGGGGSGGGGSGGGGSQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9266 - protein, 448 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKGGGGSGGGGSGGGGSQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9267 - protein, 444 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLGGGGSGGGGSGGGGSQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9268 - protein, 442 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKGGGGSGGGGSGGGGSEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9269 - protein, 453 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRGGGGSGGGGSGGGGSEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9270 - protein, 448 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRGGGGSGGGGSGGGGSQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9271 - protein, 449 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKGGGGSGGGGSGGGGSQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9272 - protein, 449 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGGGGGSGGGGSGGGGSEVQLVQSGGGVVRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9273 - protein, 461 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLGGGGSGGGGSGGGGSQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9274 - protein, 455 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRGGGGSGGGGSGGGGSQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9275 - protein, 445 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRGGGGSGGGGSGGGGSQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9276 - protein, 444 aa, Artificial Sequence
  Synthetic Polypeptide
MALPVTALLLPLALLLHAARPELTQDPAVSVALGQTVRITCQGDSLRSNYANWYQQKPGQAPVLVIYGQNNRPSGIPDRFSGSSSGNTASLTITGAQAADEADYYCDSRVSTGNHVVFGGGTKLTVLGQGGGGSGGGGSGGGGSEVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDISYGSFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9277 - protein, 446 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKGGGGSGGGGSGGGGSQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9278 - protein, 437 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKGGGGSGGGGSGGGGSEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9279 - protein, 440 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKGGGGSGGGGSGGGGSEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9280 - protein, 447 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRGGGGSGGGGSGGGGSEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9281 - protein, 443 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKGGGGSGGGGSGGGGSEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9282 - protein, 444 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKGGGGSGGGGSGGGGSQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9283 - protein, 445 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKGGGGSGGGGSGGGGSEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9284 - protein, 450 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRGGGGSGGGGSGGGGSQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9285 - protein, 457 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKGGGGSGGGGSGGGGSQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9286 - protein, 451 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRGGGGSGGGGSGGGGSQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWPMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9287 - protein, 456 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9288 - protein, 453 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKGGGGSGGGGSGGGGSEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9289 - protein, 458 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRGGGGSGGGGSGGGGSQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9290 - protein, 463 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9291 - protein, 468 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRGGGGSGGGGSGGGGSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9292 - protein, 459 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRGGGGSGGGGSGGGGSQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9293 - protein, 455 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRGGGGSGGGGSGGGGSEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9294 - protein, 460 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRGGGGSGGGGSGGGGSEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9295 - protein, 450 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKGGGGSGGGGSGGGGSQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9296 - protein, 450 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKGGGGSGGGGSGGGGSQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9297 - protein, 454 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKGGGGSGGGGSGGGGSQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9298 - protein, 458 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKAGGGGSGGGGSGGGGSEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9299 - protein, 458 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9300 - protein, 460 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRGGGGSGGGGSGGGGSQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9301 - protein, 460 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRGGGGSGGGGSGGGGSEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9302 - protein, 457 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRGGGGSGGGGSGGGGSQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9303 - protein, 457 aa, Artificial Sequence
  Synthetic Polypeptide
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9304 - protein, 463 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRGGGGSGGGGSGGGGSQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9305 - protein, 463 aa, Artificial Sequence
  Synthetic Polypeptide
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9306 - protein, 453 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKGGGGSGGGGSGGGGSQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9307 - protein, 453 aa, Artificial Sequence
  Synthetic Polypeptide
MALPVTALLLPLALLLHAARPQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSGGGGSGGGGSGGGGSDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9308 - protein, 428 aa, Artificial Sequence; identical to SEQ ID NO: 9058
  Synthetic Polypeptide

SEQ ID NO: 9309 - protein, 428 aa, Artificial Sequence; identical to SEQ ID NO: 9058
  Synthetic Polypeptide

SEQ ID NO: 9310 - protein, 431 aa, Artificial Sequence; identical to SEQ ID NO: 9060
  Synthetic Polypeptide

SEQ ID NO: 9311 - protein, 431 aa, Artificial Sequence; identical to SEQ ID NO: 9060
  Synthetic Polypeptide

SEQ ID NO: 9312 - protein, 458 aa, Artificial Sequence
  Synthetic Polypeptide
MALPVTALLLPLALLLHAARPDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRGGGGSGGGGSGGGGSQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9313 - protein, 458 aa, Artificial Sequence
  Synthetic Polypeptide
MALPVTALLLPLALLLHAARPQLQLQESGPGLVKPSETLSLTCTVSGGSISSSTYYWGWIRQPPGKGLEWIGSIYFTGSTDYNPSLKSRVSISVDTSKNQFSLKLSSVTAADTAVYYCAKEDDSSGYYSFDYWGQGNLVTVSSGGGGSGGGGSGGGGSDIQLTQSPSFLSASVGDRVTITCRASQGISSYLAWYQQKPGKAPKLLIYAASTLQSGVPSRFSGSGSGTEFTLTISSLQPEDFATYYCQQVNSYPLTFGGGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9314 - protein, 461 aa, Artificial Sequence
  Synthetic Polypeptide
MALPVTALLLPLALLLHAARPQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQGGGGSGGGGSGGGGSQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9315 - protein, 461 aa, Artificial Sequence
  Synthetic Polypeptide
MALPVTALLLPLALLLHAARPQVQLVQSGSELKKPGASVKVSCKASGYTFNTYAMNWVRQAPGQGLEWMGWINTNTGNPTYAQGFTGRFVFSLDTSVSTAYLQISSLKAEDTAVYYCARRYFDWLLGAFDIWGQGTMVTVSSGGGGSGGGGSGGGGSQSALTQPRSVSGSPGHSVTISCTGTSSDVGDYNYVSWYQQRPGKVPKLLIYDVSKRPSGVPDRFSGSKSGNTASLTISGLQAEDEAIYFCASYAGNYNVVFGGGTKLTVLGQTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9316 - protein, 453 aa, Artificial Sequence
  Synthetic Polypeptide
MALPVTALLLPLALLLHAARPDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRGGGGSGGGGSGGGGSQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9317 - protein, 453 aa, Artificial Sequence
  Synthetic Polypeptide
MALPVTALLLPLALLLHAARPQVQLVQSGAEVKKPGSSVKVSCKASGYAFSSSWMNWVRQAPGQGLEWMGRIYPGDGNTHYAQKFQGRVTLTADKSTSTAYMELSSLRSEDTAVYYCGEGYLDPMDYWGQGTLVTVSSGGGGSGGGGSGGGGSDIQMTQSPSSLSASVGDRVTITCSASQGINNYLNWYQQKPGKAPKLLIHYTSGLHAGVPSRFSGSGSGTDYTLTISSLQPEDVATYYCQQYSILPWTFGGGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9318 - protein, 461 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRGGGGSGGGGSGGGGSQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9319 - protein, 461 aa, Artificial Sequence
  Synthetic Polypeptide
MALPVTALLLPLALLLHAARPQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSGGGGSGGGGSGGGGSDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9320 - protein, 456 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRGGGGSGGGGSGGGGSEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9321 - protein, 456 aa, Artificial Sequence
  Synthetic Polypeptide
MALPVTALLLPLALLLHAARPEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSGGGGSGGGGSGGGGSDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9322 - protein, 453 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRGGGGSGGGGSGGGGSEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9323 - protein, 453 aa, Artificial Sequence
  Synthetic Polypeptide
MALPVTALLLPLALLLHAARPEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSGGGGSGGGGSGGGGSDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9324 - protein, 453 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVGGGGSGGGGSGGGGSEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9325 - protein, 453 aa, Artificial Sequence
  Synthetic Polypeptide
MALPVTALLLPLALLLHAARPEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSGGGGSGGGGSGGGGSDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9326 - protein, 461 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGGGGGSGGGGSGGGGSQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9327 - protein, 461 aa, Artificial Sequence
  Synthetic Polypeptide
MALPVTALLLPLALLLHAARPQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSGGGGSGGGGSGGGGSQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9328 - protein, 468 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVGGGGSGGGGSGGGGSEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9329 - protein, 468 aa, Artificial Sequence
  Synthetic Polypeptide
MALPVTALLLPLALLLHAARPEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSGGGGSGGGGSGGGGSDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVTREQKLISEEDLIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9330 - protein, 441 aa, Artificial Sequence
  Synthetic Polypeptide
MALPVTALLLPLALLLHAARPVVMTQTPLSLSVTLGQPASISCKSSQSLLHSDGKTYLNWLQQRPGQSPRRLIYLVSKLDSGVPDRFSGSGSGTDFTLKISRVEAEDVGIYYCWQGTHLWTFGGGTKVEIKGGGGSGGGGSGGGGSEVHLVESGGGLVQPGGSLRLSCAASGFTFSRYGMSWVRQAPGKGLELVAMMKTKGGRTYYPDSVKGRFTISRDNAKNSLYLQMNSLRAEDTAIYYCASDGYYWGQGTTVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9331 - protein, 444 aa, Artificial Sequence
  Synthetic Polypeptide
MALPVTALLLPLALLLHAARPEIVLTQSPATLSLSPGERATLSCSATSSVSYMHWYQQKPGKAPKRWIYDTSKLASGVPSRFSGSGSGTEFTLTISSLQPEDFATYYCQQWSSNPLTFGQGTKLEIKGGGGSGGGGSGGGGSQVQLVQSGAEVKKPGASVKVSCKASGYKFTSYVMHWVRQAPGQGLEWIGYINPYNDVTKYNEKFKGRVTITADKSTSTAYMELSSLRSEDTAVHYCARGSYYDYDGFVYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9332 - protein, 449 aa, Artificial Sequence
  Synthetic Polypeptide
MALPVTALLLPLALLLHAARPDIVMTQSPDSLAVSLGERATINCKSSQSLLNSRTRKNYLAWYQQKPGQSPKLLIYWTSTRKSGVPDRFSGSGSGTDFTLTISSLQAEDVAVYYCKQSFILRTFGQGTKVEIKGGGGSGGGGSGGGGSEVQLVQSGAEVKKPGASVKVSCKASGFTFTSYYIHWVRQAPGQGLEWIGWIYPENDNTKYNEKFKDRVTITADTSTSTAYLELSSLRSEDTAVYYCARDAYSRYYFDYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9333 - protein, 452 aa, Artificial Sequence
  Synthetic Polypeptide
MALPVTALLLPLALLLHAARPDIVMTQSPLSLPVTPGEPASISCRSSQRLLSSYGHTYLHWYLQKPGQSPQLLIYEVSNRFSGVPDRFSGSGSGTDFTLKISRVEAEDVGVYYCSQSTHVPLTFGQGTKVEIKGGGGSGGGGSGGGGSEVQLVESGGGLVKPGGSLRLSCAASGYTFSNYWIGWVRQAPGKGLEWIGDIYPGGNYIRNNEKFKDKTTLSADTSKNTAYLQMNSLKTEDTAVYYCGSSFGSNYVFAWFTYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9334 - protein, 450 aa, Artificial Sequence
  Synthetic Polypeptide
MALPVTALLLPLALLLHAARPDIVMSQSPSSLAVSAGEKVTMSCKSSQSLFNSRTRKNYLAWYQQKPGQSPKLLIYWASARDSGVPARFTGSGSETYFTLTISRVQAEDLAVYYCMQSFNLRTFGGGTKLEIKGGGGSGGGGSGGGGSEVNLVESGGGLVQPGGSLRLSCATSGFTFTDNYMSWVRQPPGKALEWLGFIRNKANGYTTDYSASVRGRFTISRDNSQSILYLQMNALRAEDSATYYCARDVGSNYFDYWGQGTTLTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9335 - protein, 451 aa, Artificial Sequence
  Synthetic Polypeptide
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEWKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9336 - protein, 447 aa, Artificial Sequence
  Synthetic Polypeptide
MALPVTALLLPLALLLHAARPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGGGGSGGGGSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9337 - protein, 449 aa, Artificial Sequence
  Synthetic Polypeptide
MALPVTALLLPLALLLHAARPSTGSQVQLQQSGPELVKPGASVKMSCKASGYTFTDYVINWGKQRSGQGLEWIGEIYPGSGTNYYNEKFKAKATLTADKSSNIAYMQLSSLTSEDSAVYFCARRGRYGLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTINNLEQEDIATYFCQQGNTRPWTFGGGTKLEIKTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9338 - protein, 444 aa, Artificial Sequence
  Synthetic Polypeptide
MALPVTALLLPLALLLHAARPQIVLTQSPAIMSASPGEKVTMTCSATSSVSYMHWYQQKSGTSPKRWIYDTSKLASGVPARFSGSGSGTSYSLTISSMEAEDAATYYCQQWSSNPLTFGAGTKLELKGGGGSGGGGSGGGGSEVQLQQSGPELVKPGASVKMSCKASGYKFTSYVMHWVKQKPGQGLEWIGYINPYNDVTKYNEKFKGKATLTSDKSSSTAYMELSSLTSEDSAVHYCARGSYYDYDGFVYWGQGTLVTVSATRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9339 - protein, 445 aa, Artificial Sequence
  Synthetic Polypeptide
MALPVTALLLPLALLLHAARPDIQMTQSPASQSASLGESVTITCLASQTIGTWLAWYQQKPGKSPQLLIYAATSLADGVPSRFSGSGSGTKFSLKIRTLQAEDFVSYYCQQLYSKPYTFGGGTKLEIKRGGGGSGGGGSGGGGSEVQLQQSGAELVKPGASVKLSCTPSGFNVKDTYIHWVKQRPKQGLEWIGRIDPSDGDIKYDPKFQGKATITADTSSNTVSLQLSSLTSEDTAVYYCARWFGDYGAMNYWGQGTSVTVSSTRIEVMYPPPYLDNEKSNGTIIHVKGKHLCPSPLFPGPSKPFWVLVVVGGVLACYSLLVTVAFIIFWVRSKRSGGGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKPE

SEQ ID NO: 9340 - skipped

SEQ ID NO: 9341 - protein, 818 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 9342 - protein, 801 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPFCIIAFIFIATVIALRKQLCQKLYSSKDTTKRPVTTTKREVNSAI

SEQ ID NO: 9343 - protein, 769 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMSDSKEVPSLPFLRHLLEELDSHEDSLLLFLCHDAAPGCTTVTQALCSLSQQRKLTLAALVEMLYVLQRMDLLKSRFGLSKEGAEQLLGTSFLTRYRKLMVCVGEELDSSELRALRLFACNLNPSLSTALSESSRFVELVLALENVGLVSPSSVSVLADMLRTLRRLDLCQQLVEYEQQEQARYRYCYAASPSLPVRTLRRGHGASEHEQLCMPVQESSDSPELLRTPVQESSSDSPEQTT

SEQ ID NO: 9344 - protein, 869 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMDIFREIASSMKGENVFISPPSISSVLTILYYGANGSTAEQLSKYVEKEADKNKDDISFKSMNKVYGRYSAVFKDSFLRKIGDNFQTVDFTDCRTVDAINKCVDIFTEGKINPLLDEPLSPDTCLLAISAVYFKAKWLMPFEKEFTSDYPFYVSPTEMVDVSMMSMYGEAFNHASVKESFGNFSIIELPYVGDTSMVVILPDNIDGLESIEQNLTDTNFKKWCDSMDAMFIDVHIPKFKVTGSYNLVDALVKLGLTEVFGSTGDYSNMCNSDVSVDAMIHKTYIDVNEEYTEAAAATCALVADCASTVTNEFCADHPFIYVIRHVDGKILFVGRYCSPTTN

SEQ ID NO: 9345 - protein, 827 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSRVEQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMCVIFPVEIDVSQTIIRDCQVDKQTRELVYINKIMNTQLTKPVLMMFNISGPIRSVTRKNNNLRDRIKSKVDEQFDQLERDYSDQMDGFHDSIKYFKDEHYSVSCQNGSVLKSKFAKILKSHDYTDKKSIEAYEKYCLPKLVDERNDYYVAVCVLKPGFENGSNQVLSFEYNPIGNKVIVPFAHEINDTGLYEYDVVAYVDSVQFDGEQFEEFVQSLILPSSFKNSEKVLYYNEASKNKSMIYKALEFTTESSWGKSEKYNWKIFCNGFIYDKKSKVLYVKLHNVTSALNKNVILNTIK

SEQ ID NO: 9346 - skipped

SEQ ID NO: 9347 - protein, 619 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9348 - protein, 620 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9349 - protein, 621 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9350 - protein, 628 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9351 - protein, 627 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9352 - protein, 619 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9353 - protein, 629 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9354 - protein, 620 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9355 - protein, 624 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9356 - protein, 622 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9357 - protein, 622 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9358 - protein, 623 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9359 - protein, 620 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9360 - protein, 623 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9361 - protein, 747 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9362 - protein, 623 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9363 - protein, 623 aa, Artificial Sequence; identical to SEQ ID NO: 9362
  Synthetic Polypeptide

SEQ ID NO: 9364 - protein, 623 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9365 - protein, 625 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9366 - protein, 626 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9367 - protein, 618 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9368 - protein, 624 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9369 - protein, 617 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9370 - protein, 622 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9371 - protein, 619 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9372 - protein, 629 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9373 - protein, 625 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9374 - protein, 629 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9375 - protein, 614 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9376 - protein, 623 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9377 - protein, 619 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9378 - protein, 627 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9379 - protein, 622 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9380 - protein, 617 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9381 - protein, 620 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9382 - protein, 615 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9383 - protein, 625 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9384 - protein, 617 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9385 - protein, 620 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9386 - protein, 630 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9387 - protein, 627 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9388 - protein, 619 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9389 - protein, 612 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9390 - protein, 617 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9391 - protein, 620 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9392 - protein, 625 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9393 - protein, 622 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9394 - protein, 620 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9395 - protein, 620 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9396 - protein, 626 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9397 - protein, 626 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9398 - protein, 624 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9399 - protein, 619 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9400 - protein, 614 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9401 - protein, 620 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9402 - protein, 627 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9403 - protein, 628 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9404 - protein, 625 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9405 - protein, 622 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9406 - protein, 623 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9407 - protein, 620 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9408 - protein, 618 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9409 - protein, 620 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9410 - protein, 622 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9411 - protein, 627 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9412 - protein, 621 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9413 - protein, 622 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9414 - protein, 620 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9415 - protein, 619 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9416 - protein, 620 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9417 - protein, 619 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9418 - protein, 620 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9419 - protein, 627 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9420 - protein, 633 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9421 - protein, 618 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9422 - protein, 628 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9423 - protein, 608 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9424 - protein, 754 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9425 - protein, 618 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9426 - protein, 622 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9427 - protein, 618 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9428 - protein, 619 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9429 - protein, 624 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9430 - protein, 618 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9431 - protein, 619 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9432 - protein, 627 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9433 - protein, 623 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9434 - protein, 620 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9435 - protein, 620 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9436 - protein, 619 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9437 - protein, 619 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9438 - protein, 623 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9439 - protein, 626 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9440 - protein, 628 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9441 - protein, 627 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9442 - protein, 617 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9443 - protein, 619 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9444 - protein, 621 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9445 - protein, 622 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9446 - protein, 618 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9447 - protein, 637 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9448 - protein, 634 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9449 - protein, 608 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9450 - protein, 624 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9451 - protein, 615 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9452 - protein, 616 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9453 - protein, 616 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9454 - protein, 627 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9455 - protein, 623 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9456 - protein, 618 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9457 - protein, 622 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9458 - protein, 631 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9459 - protein, 622 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9460 - protein, 625 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9461 - protein, 620 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9462 - protein, 621 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9463 - protein, 630 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9464 - protein, 620 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9465 - protein, 617 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9466 - protein, 622 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9467 - protein, 621 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9468 - protein, 623 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9469 - protein, 602 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9470 - protein, 619 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9471 - protein, 617 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9472 - protein, 628 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9473 - protein, 623 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9474 - protein, 624 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9475 - protein, 623 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9476 - protein, 636 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9477 - protein, 630 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9478 - protein, 621 aa, Artificial Sequence
  Synthetic Polypeptide
MALPVTALLLPLALLLHAARPIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9479 - protein, 620 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9480 - protein, 621 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9481 - protein, 612 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9482 - protein, 615 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9483 - protein, 622 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9484 - protein, 618 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9485 - protein, 619 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9486 - protein, 620 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9487 - protein, 625 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9488 - protein, 621 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9489 - protein, 627 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9490 - protein, 632 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9491 - protein, 632 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9492 - protein, 621 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9493 - protein, 622 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9494 - protein, 626 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9495 - protein, 626 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9496 - protein, 620 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9497 - protein, 622 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9498 - protein, 619 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9499 - protein, 620 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9500 - protein, 616 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9501 - protein, 619 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9502 - protein, 618 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9503 - protein, 627 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9504 - protein, 631 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9505 - protein, 626 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9506 - protein, 622 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9507 - protein, 622 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9508 - protein, 625 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9509 - protein, 623 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9510 - protein, 622 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9511 - protein, 624 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9512 - protein, 621 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9513 - protein, 622 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9514 - protein, 623 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9515 - protein, 622 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9516 - protein, 617 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9517 - protein, 622 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9518 - protein, 621 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9519 - protein, 621 aa, Artificial Sequence; identical to SEQ ID NO: 9518
  Synthetic Polypeptide

SEQ ID NO: 9520 - protein, 618 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9521 - protein, 619 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9522 - protein, 620 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9523 - protein, 626 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9524 - protein, 624 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9525 - protein, 624 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9526 - protein, 622 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9527 - protein, 623 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9528 - protein, 623 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9529 - protein, 623 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9530 - protein, 621 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9531 - protein, 621 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9532 - protein, 623 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9533 - protein, 629 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9534 - protein, 620 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9535 - protein, 622 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9536 - protein, 624 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9537 - protein, 628 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9538 - protein, 625 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9539 - protein, 618 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9540 - protein, 622 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9541 - protein, 623 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9542 - protein, 632 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9543 - protein, 610 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9544 - protein, 632 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9545 - protein, 631 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9546 - protein, 631 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9547 - protein, 627 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9548 - protein, 612 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9549 - protein, 631 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9550 - protein, 621 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9551 - protein, 624 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9552 - protein, 616 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9553 - protein, 624 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9554 - protein, 622 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9555 - protein, 621 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9556 - protein, 624 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9557 - protein, 618 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9558 - protein, 625 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9559 - protein, 622 aa, Artificial Sequence; identical to SEQ ID NO: 9493
  Synthetic Polypeptide

SEQ ID NO: 9560 - protein, 623 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9561 - protein, 621 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9562 - protein, 622 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9563 - protein, 618 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9564 - protein, 620 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9565 - protein, 623 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9566 - protein, 633 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9567 - protein, 626 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9568 - protein, 618 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9569 - protein, 625 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9570 - protein, 618 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9571 - protein, 626 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9572 - protein, 601 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPARGPEERVPTGGRVRARGRDQPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRTDPVGGIRGRCGAAGEPETVMRGVWLHIQELRHALGATGPRKGFGVGRRDLVRRIVLRRSCEGKVHHLPRQQKYALPANELTQGGYGGLLLRSLRDCCGRRIRLLGTGYPGDSIKHAYPEPSCRVPAAGQEQRQERVSVHRLRQPDQRVPEQGLRRVHHRVRAGHAEHGLQEQLRRGLVQQVRFRLRQRLQQQHYPRGHILPKPREQLRREAGGKELRDRHQPELPEPERDRLPDPAAESGRLPADDPAAVVQ

SEQ ID NO: 9573 - protein, 612 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHARKLLRSLDLYWSQPRHHSRVQVVFPSTQGWASAGSGNPLARLWNGSLTYSAMPKKATGQANPALFPRTLLSLRWCPPTWTRWTPPPITAQESLGMVGMVTTIIMGWMCGGKAQPRSQARVSRTLILPCTSCGIARAATRACVCSPTSTARPTCPRARTPTCTSPISACWTCGAWTSRATPPWPGPTSPISPAPTPSTTALSPRTHSSQAPRAAATSWWKRASRQTPTTSRTASASSCCKWPALTCPCGCGP

SEQ ID NO: 9574 - protein, 618 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9575 - protein, 618 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9576 - protein, 623 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9577 - protein, 628 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9578 - protein, 633 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9579 - protein, 624 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9580 - protein, 620 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9581 - protein, 621 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9582 - protein, 598 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKSSRTRTCSHLRWPCSSLARPRSATPRKPPSCAWLPASTPTMWNCLGGSTAKRCTAACVPTPSHKNSPPTTAGTAAADECPPPSGRTPGTTSDARCSSTAARTTSGPRTEPSPPRSCLPKPGAEPIAALPARATSRACAPPSCTRSCWARPPCTPCWCLPWCWLWSSGRTAGEGPSDLDLEQQTSHYSNKQVTWRRIPGLLVWTGFGASFSLSALLPARIPSNRSNCKKADPDWSLLRHLVRARSVAAPSPPIIGHGYDNPQVRAWNGLAISTIQEARTTIPASPEQFQIPVKTSSVLNCQAQLPTPLCITASHWCIVEGIVIAGSIIGDREPWLYLPRVSRTLILPCTSCGIARAATRACVCSPTSTARPTCPRARTPTCTSPISACWTCGAWTSRATPPWPGPTSPISPAPTPSTTALSPRTHSSQAPRAAATSWWKRASRQTPTTSRTASASSCCKWPALTCPCGCGP

SEQ ID NO: 9583 - protein, 625 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9584 - protein, 621 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9585 - protein, 618 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9586 - protein, 619 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9587 - protein, 625 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9588 - protein, 615 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9589 - protein, 615 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSS

SEQ ID NO: 9590 - skipped

SEQ ID NO: 9591 - protein, 619 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9592 - protein, 620 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9593 - protein, 621 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9594 - protein, 628 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9595 - protein, 627 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9596 - protein, 619 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9597 - protein, 629 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9598 - protein, 620 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9599 - protein, 624 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9600 - protein, 622 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9601 - protein, 622 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9602 - protein, 623 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9603 - protein, 620 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9604 - protein, 623 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9605 - protein, 747 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9606 - protein, 623 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9607 - protein, 623 aa, Artificial Sequence; identical to SEQ ID NO: 9606
  Synthetic Polypeptide

SEQ ID NO: 9608 - protein, 623 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9609 - protein, 625 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9610 - protein, 626 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9611 - protein, 618 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9612 - protein, 624 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9613 - protein, 617 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9614 - protein, 622 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9615 - protein, 619 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9616 - protein, 629 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9617 - protein, 625 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9618 - protein, 629 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9619 - protein, 614 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9620 - protein, 623 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9621 - protein, 619 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9622 - protein, 627 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9623 - protein, 622 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9624 - protein, 617 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9625 - protein, 620 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9626 - protein, 615 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9627 - protein, 625 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9628 - protein, 617 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9629 - protein, 620 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9630 - protein, 630 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9631 - protein, 627 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9632 - protein, 619 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9633 - protein, 612 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9634 - protein, 617 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9635 - protein, 620 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9636 - protein, 625 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9637 - protein, 622 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9638 - protein, 620 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9639 - protein, 620 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9640 - protein, 626 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9641 - protein, 626 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9642 - protein, 624 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9643 - protein, 619 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9644 - protein, 614 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9645 - protein, 620 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9646 - protein, 627 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9647 - protein, 628 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9648 - protein, 625 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9649 - protein, 622 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9650 - protein, 623 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9651 - protein, 620 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9652 - protein, 618 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9653 - protein, 620 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9654 - protein, 622 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9655 - protein, 627 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9656 - protein, 621 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9657 - protein, 622 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9658 - protein, 620 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9659 - protein, 619 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9660 - protein, 620 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9661 - protein, 619 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9662 - protein, 620 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9663 - protein, 627 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9664 - protein, 633 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9665 - protein, 618 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9666 - protein, 628 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9667 - protein, 608 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9668 - protein, 754 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9669 - protein, 618 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9670 - protein, 622 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9671 - protein, 618 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9672 - protein, 619 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9673 - protein, 624 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9674 - protein, 618 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9675 - protein, 619 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9676 - protein, 627 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9677 - protein, 623 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9678 - protein, 620 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9679 - protein, 620 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9680 - protein, 619 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9681 - protein, 619 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9682 - protein, 623 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9683 - protein, 626 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9684 - protein, 628 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9685 - protein, 627 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9686 - protein, 617 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9687 - protein, 619 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9688 - protein, 621 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9689 - protein, 622 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9690 - protein, 618 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9691 - protein, 637 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9692 - protein, 634 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9693 - protein, 608 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9694 - protein, 624 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9695 - protein, 615 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9696 - protein, 616 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9697 - protein, 616 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9698 - protein, 627 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9699 - protein, 623 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9700 - protein, 618 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9701 - protein, 622 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9702 - protein, 631 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9703 - protein, 622 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9704 - protein, 625 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9705 - protein, 620 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9706 - protein, 621 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9707 - protein, 630 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9708 - protein, 620 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9709 - protein, 617 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9710 - protein, 622 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9711 - protein, 621 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9712 - protein, 623 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9713 - protein, 602 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9714 - protein, 619 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9715 - protein, 617 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9716 - protein, 628 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9717 - protein, 623 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9718 - protein, 624 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9719 - protein, 623 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9720 - protein, 636 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9721 - protein, 630 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9722 - protein, 621 aa, Artificial Sequence
  Synthetic Polypeptide
MALPVTALLLPLALLLHAARPIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9723 - protein, 620 aa, Artificial Sequence
  Synthetic Polypeptide
MALPVTALLLPLALLLHAARPEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9724 - protein, 621 aa, Artificial Sequence
  Synthetic Polypeptide
MALPVTALLLPLALLLHAARPDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9725 - protein, 612 aa, Artificial Sequence
  Synthetic Polypeptide
MALPVTALLLPLALLLHAARPDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9726 - protein, 615 aa, Artificial Sequence
  Synthetic Polypeptide
MALPVTALLLPLALLLHAARPDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9727 - protein, 622 aa, Artificial Sequence
  Synthetic Polypeptide
MALPVTALLLPLALLLHAARPDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9728 - protein, 618 aa, Artificial Sequence
  Synthetic Polypeptide
MALPVTALLLPLALLLHAARPDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9729 - protein, 619 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9730 - protein, 620 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9731 - protein, 625 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9732 - protein, 621 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9733 - protein, 627 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9734 - protein, 632 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9735 - protein, 632 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9736 - protein, 621 aa, Artificial Sequence
  Synthetic Polypeptide
MALPVTALLLPLALLLHAARPDIVLTQSPASLAVSLGERATINCRASESVSVIGAHLIHWYQQKPGQPPKLLIYLASNLETGVPARFSGSGSGTDFTLTISSLQAEDAAIYYCLQSRIFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTDYSINWVKQAPGQGLKWMGWINTETREPAYAYDFRGRFVFSLDTSASTAYLQISSLKAEDTAVYFCALDYSYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9737 - protein, 622 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9738 - protein, 626 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9739 - protein, 626 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9740 - protein, 620 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9741 - protein, 622 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9742 - protein, 619 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9743 - protein, 620 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9744 - protein, 616 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9745 - protein, 619 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9746 - protein, 618 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9747 - protein, 627 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9748 - protein, 631 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9749 - protein, 626 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9750 - protein, 622 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9751 - protein, 622 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9752 - protein, 625 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9753 - protein, 623 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9754 - protein, 622 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9755 - protein, 624 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9756 - protein, 621 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9757 - protein, 622 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9758 - protein, 623 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9759 - protein, 622 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9760 - protein, 617 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9761 - protein, 622 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9762 - protein, 621 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9763 - protein, 621 aa, Artificial Sequence; identical to SEQ ID NO: 9762
  Synthetic Polypeptide

SEQ ID NO: 9764 - protein, 618 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9765 - protein, 619 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9766 - protein, 620 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9767 - protein, 626 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9768 - protein, 624 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9769 - protein, 624 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9770 - protein, 622 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9771 - protein, 623 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9772 - protein, 623 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9773 - protein, 623 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9774 - protein, 621 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9775 - protein, 621 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9776 - protein, 623 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9777 - protein, 629 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9778 - protein, 620 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9779 - protein, 622 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9780 - protein, 624 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9781 - protein, 628 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9782 - protein, 625 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9783 - protein, 618 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9784 - protein, 622 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9785 - protein, 623 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9786 - protein, 632 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9787 - protein, 610 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9788 - protein, 632 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9789 - protein, 631 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9790 - protein, 631 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9791 - protein, 627 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9792 - protein, 612 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9793 - protein, 631 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9794 - protein, 621 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9795 - protein, 624 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9796 - protein, 616 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9797 - protein, 624 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9798 - protein, 622 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9799 - protein, 621 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9800 - protein, 624 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9801 - protein, 618 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9802 - protein, 625 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9803 - protein, 622 aa, Artificial Sequence; identical to SEQ ID NO: 9737
  Synthetic Polypeptide

SEQ ID NO: 9804 - protein, 623 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9805 - protein, 621 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9806 - protein, 622 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9807 - protein, 618 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9808 - protein, 620 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9809 - protein, 623 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9810 - protein, 633 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9811 - protein, 626 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9812 - protein, 618 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9813 - protein, 625 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9814 - protein, 618 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9815 - protein, 626 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9816 - protein, 602 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPARGPEERVPTGGRVRARGRDQPHPESHPRVPGYRLLPRPCGTVLVGQRQRGAQRRVYRPPATERTARPERQPVLPEQQTESVRHLLAEPPEPLQMPGAVLRPERERRVDPGQSQARDPDRVCRSLGQSRLRLYQRELPAGRAERHHPVRDPAGQGHPVRRAGVCPGADGYGQAEGQPGKGQAIWIWSNKLLTTQTSRRGGESRAYYGLDLAHPFPCRRCYRRAFLRTDPVGGIRGRCGAAGEPETVMRGVWLHIQELRHALGATGPRKGFGVGRRDLVRRIVLRRSCEGKVHHLPRQQKYALPANELTQGGYGGLLLRSLRDCCGRRIRLLGTGYPGDSIKHAYPEPSCRVPAAGQEQRQERVSVHRLRQPDQRVPEQGLRRVHHRVRAGHAEHGLQEQLRRGLVQQVRFRLRQRLQQQHYPRGHILPKPREQLRREAGGKELRDRHQPELPEPERDRLQNPAAESGPVCPADDPAAVVQ

SEQ ID NO: 9817 - protein, 613 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEHARKLLRSLDLYWSQPRHHSRVQVVFPSTQGWASAGSGNPLARLWNGSLTYSAMPKKATGQANPALFPRTLLSLRWCPPTWTRWTPPPITAQESLGMVGMVTTIIMGWMCGGKAQPRSQARVSRTLILPCTSCGIARAATRACVCSPTSTARPTCPRARTPTCTSPISACWTCGAWTSRATPPWPGPTSPISPAPTPSTTALSPRTHSSQAPRAAATSWWKRASRQTPTTSRTASASESCCKWPCLPCPCGCGP

SEQ ID NO: 9818 - protein, 618 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9819 - protein, 618 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9820 - protein, 623 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9821 - protein, 628 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9822 - protein, 633 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9823 - protein, 624 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9824 - protein, 620 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9825 - protein, 621 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9826 - protein, 599 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKSSRTRTCSHLRWPCSSLARPRSATPRKPPSCAWLPASTPTMWNCLGGSTAKRCTAACVPTPSHKNSPPTTAGTAAADECPPPSGRTPGTTSDARCSSTAARTTSGPRTEPSPPRSCLPKPGAEPIAALPARATSRACAPPSCTRSCWARPPCTPCWCLPWCWLWSSGRTAGEGPSDLDLEQQTSHYSNKQVTWRRIPGLLVWTGFGASFSLSALLPARIPSNRSNCKKADPDWSLLRHLVRARSVAAPSPPIIGHGYDNPQVRAWNGLAISTIQEARTTIPASPEQFQIPVKTSSVLNCQAQLPTPLCITASHWCIVEGIVIAGSIIGDREPWLYLPRVSRTLILPCTSCGIARAATRACVCSPTSTARPTCPRARTPTCTSPISACWTCGAWTSRATPPWPGPTSPISPAPTPSTTALSPRTHSSQAPRAAATSWWKRASRQTPTTSRTASASESCCKWPCLPCPCGCGP

SEQ ID NO: 9827 - protein, 625 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9828 - protein, 621 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9829 - protein, 618 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9830 - protein, 619 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9831 - protein, 625 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9832 - protein, 615 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9833 - protein, 615 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSS

SEQ ID NO: 9834 - skipped

SEQ ID NO: 9835 - protein, 623 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9836 - protein, 624 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9837 - protein, 625 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9838 - protein, 632 aa, Artificial Sequence
  Synthetic Polypeptide
MALPVTALLLPLALLLHAARPDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9839 - protein, 631 aa, Artificial Sequence
  Synthetic Polypeptide
MALPVTALLLPLALLLHAARPDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9840 - protein, 623 aa, Artificial Sequence
  Synthetic Polypeptide
MALPVTALLLPLALLLHAARPDYIHVTQSPSSLSVSIGDRVTINCQTSQGVGSDLHWYQHKPGRAPKLLIHHASSVEDGVPSRFSGTGFHTSFNLTINDLQADDIGTYYCQVLQSFGRGSRLDTKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFERAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9841 - protein, 633 aa, Artificial Sequence
  Synthetic Polypeptide
MALPVTALLLPLALLLHAARPDVQMIQTPDSLAVSLGQRATISCRASESVDNYGISFMHWYQQKPGQSPKLLIYRASNLESGIPARFSGSGSRTDFTLTINPVETDDVATYYCQQNNKDPPTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEGGGGSQVQLQQSGAELVKPGASVKISCKASGYAFSSYWMNWVKQRPGKGLEWIGQIYPGDGDTTYNGKFKGKATLTADKSSSTVYMQLNSLTSEDSAVYFCVRYYYGSSGYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9842 - protein, 624 aa, Artificial Sequence
  Synthetic Polypeptide
MALPVTALLLPLALLLHAARPDVQMIQTPSSLSASLGDRVTISCRASQDIGNYLNWYQQKPDGTVKLLIYYTSRLHSGVPSRFSGSGSGTEYSLTISNLEQEDIATYFCQQGSALPPTFGGGTKLEINLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEALQLQQSGAELVRPGASVTLSCKASGYTFTDYEMHWVKQTPVHGLEWIGAIDPETGGTAYNQKFEGKAILTADKSSSTAYMELRSLTSEDSPVYYCARRRYYGSSSFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9843 - protein, 628 aa, Artificial Sequence
  Synthetic Polypeptide
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9844 - protein, 626 aa, Artificial Sequence
  Synthetic Polypeptide
MALPVTALLLPLALLLHAARPDIQMTQSPSSLSASVGDRVTITCSASQDISNYLNWYQQKPGKAPKLLIYYTSNLHSGVPSRFSGSGSGTDFTLTISSLQPEDFATYYCQQYRKLPWTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSNYWMHWVRQAPGQGLEWMGATYRGHSDTYYNQKFKGRVTITADKSTSTAYMELSSLRSEDTAVYYCARGAIYDGYDVLDNWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9845 - protein, 626 aa, Artificial Sequence
  Synthetic Polypeptide
MALPVTALLLPLALLLHAARPDIVLTQSPATLSLSPGDRATISCRASESVTILGSHLIYWYQQKPGQPPRLLIQLASNVQTGVPARFSGSGSRTDFTLTISSVEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGPEVKKPGESVKISCKASGYTFRHYSMNWVKQAPGQGLKWMGRINTESGVPIYADDFKGRFSFTVDTSASTAYLEISSLTSEDTAVYFCSNDYLYSLDFWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9846 - protein, 627 aa, Artificial Sequence
  Synthetic Polypeptide
MALPVTALLLPLALLLHAARPQSVLTQPPSVSGAPGQRVTISCTGSSSNIGAGFDVHWYQQLPGTAPKLLIYGNSNRPSGVPDRFSGSKSGTSASLAITGLQAEDEADYYCQSYDSSLSGYVFGTGTKVTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTDYYMHWVRQAPGQRLEWMGWINPNSGGTNYAQKFQDRITVTRDTSSNTGYMELTRLRSDDTAVYYCARSPYSGVLDKWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9847 - protein, 624 aa, Artificial Sequence
  Synthetic Polypeptide
MALPVTALLLPLALLLHAARPQAVLTQPPSASGTPGQRVTISCSGSSSNIGSYTVSWYQQLPGTAPKFLIYSNNQRPSGVPDRFSGSKSGTSASLAISGLQSEDEADYYCAAWDDSLNGYVFGTGTKVTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVQSGAEVKKPGESLKISCKGSGYDFTTYWIGWVRQMPGKGLEWMGIIYPGDSDTRYSPSVRGRVTISADKSINTAYLQWSSLEASDTAMYYCARMWTFSQDGWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9848 - protein, 627 aa, Artificial Sequence
  Synthetic Polypeptide
MALPVTALLLPLALLLHAARPDIVMTQSPDSLAVSLGERATINCKSSQSILYSSNQKNYLAWYQQKPGQSPKLLIYWASTRESGVPDRFSGSGSGTDFTLTISSLQAEDVAVYYCHQYISSYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFASQWMHWMRQAPGQGLEWIGWINPGNVNTKYNEKFKGRATLTVDTSTNTAYMELSSLRSEDTAVYYCARSTWYRPLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9849 - protein, 751 aa, Artificial Sequence
  Synthetic Polypeptide
MVRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9850 - protein, 627 aa, Artificial Sequence
  Synthetic Polypeptide
MALPVTALLLPLALLLHAARPDHIVLTQSPSSLSASLGDRVTISCRASQDISTYLNWYQQKPDGTVKLLIFYTSRLHAGVPSRFSGSGSGTHHSLTISNLEQEDIATYFCQQGNSLPFTFGSGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLKESGPELEKPGASVKISCKASGYSFTAYSMNWVKQNNGMSLEWIGSIDPYYGDTKYAQKFKGKATLTVDKASSTAYLQLKSLTSEDSAVYYCARRMITTGDWYFDVWGAGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9851 - protein, 627 aa, Artificial Sequence; identical to SEQ ID NO: 9850
  Synthetic Polypeptide

SEQ ID NO: 9852 - protein, 627 aa, Artificial Sequence
  Synthetic Polypeptide
MALPVTALLLPLALLLHAARPDEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9853 - protein, 629 aa, Artificial Sequence
  Synthetic Polypeptide
MALPVTALLLPLALLLHAARPDIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9854 - protein, 630 aa, Artificial Sequence
  Synthetic Polypeptide
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9855 - protein, 622 aa, Artificial Sequence
  Synthetic Polypeptide
MALPVTALLLPLALLLHAARPDIVMTQSPSSLSASVGDRVTITCKASQSVTNDVAWYQQKPGKAPKLLIYYASNRYTGVPSRFSGSGSGTDFTLTISSLQPEDFATYYCQQDYRSPWTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLEESGGGVVRPGRSLRLSCAASGFTFSDYGVNWIRQAPGKGLEWVTIIWGDGRTDYNSALKSRFTVSRNNSNNTLSLQMNSLTTEDTAVYYCVRAPGNRAMEYWGQGVLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9856 - protein, 628 aa, Artificial Sequence
  Synthetic Polypeptide
MALPVTALLLPLALLLHAARPDIQMTQSPSSLSASVGDRVTITCRASQTIWSYLNWYQQRPGKAPNLLIYAASSLQSGVPSRFSGRGSGTDFTLTISSLQAEDFATYYCQQSYSIPQIFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREVTGDLEDAFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9857 - protein, 621 aa, Artificial Sequence
  Synthetic Polypeptide
MALPVTALLLPLALLLHAARPDIQMTQSPATIENTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9858 - protein, 626 aa, Artificial Sequence
  Synthetic Polypeptide
MALPVTALLLPLALLLHAARPDEIVLTQSPDSLAVSLGERATINCKASQSVDFDGDSYLNWYQQKPGQPPKVLIYAASTLQSGVPSRFSGSGSGTDFTLTINSLEAEDAATYYCQQSNEDPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKVSGYTFTDYYITWVRQAPGQALEWMGWIYPGSGNTKYSQKFQGRFVFSVDTSASTAYLQLSSLKAEDTAVYYCANYGNYWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9859 - protein, 623 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGGGLVHPGGSLRLSCAGSGFAFSSSTMHWIRQAPGKGLEWISLIGSGGGIYYGDSVKGRFTISRDNAKNSLYLQMNSLRAEDMAVYYCVRGYFDWVDYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9860 - protein, 633 aa, Artificial Sequence
  Synthetic Polypeptide
MALPVTALLLPLALLLHAARPDDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVKQAPGQGLKWMGWINTYTGEPTYADDFKGRVTMTSDTSTSTAYLELHNLRSDDTAVYYCARWSWSDGYYVYFDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9861 - protein, 629 aa, Artificial Sequence
  Synthetic Polypeptide
MALPVTALLLPLALLLHAARPDEIVLTQSPGSLAVSPGERVTMSCKSSQSVFFSSSQKNYLAWYQQIPGQSPRLLIYWASTRESGVPDRFTGSGSGTDFTLTISSVQPEDLAIYYCHQYLSSRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAEVVKPGASVKMSCKASGYTFTSYYIHWIKQTPGQGLEWVGVIYPGNDDISYNQKFQGKATLTADKSSTTAYMQLSSLTSEDSAVYYCAREVRLRYFDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9862 - protein, 633 aa, Artificial Sequence
  Synthetic Polypeptide
MALPVTALLLPLALLLHAARPDVLLTQSPLSLPVTLGQPASISCRSSQTIVHSNGNTYLEWFQQRPGQSPRLLIYQVSNRFSGVPDRFSGSGSGTDFTLKISRVEAEDVGVYYCFQGSHVPRTFGGGTKVEIKRALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGSELKKPGASVKVSCKASGYTFTNYGMNWVRQAPGQGLKWMGWINTNTGEPKYAEEFKGRFALSLDTSVSTAYLQINSLKAEDTAVYFCARGYGNYARGAWLAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9863 - protein, 618 aa, Artificial Sequence
  Synthetic Polypeptide
MALPVTALLLPLALLLHAARPDEIVLTQSPATLSLSPGERATLSCSASSSINYIYWLQQKPGQAPRILIYLTSNLASGVPARFSGSGSGTDFTLTISSLEPEDFAVYYCLQWSSNPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSSYDMSWVRQAPGKGLEWVSTISSGGSYTYYLDSIKGRFTISRDNAKNSLYLQMNSLRAEDTAVYYCARQGLDYWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9864 - protein, 627 aa, Artificial Sequence
  Synthetic Polypeptide
MALPVTALLLPLALLLHAARPDIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADAFKGRFAFSLDTSTSTAYLQINSLRSDDTAVYYCARDYGDYGMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9865 - protein, 623 aa, Artificial Sequence
  Synthetic Polypeptide
MALPVTALLLPLALLLHAARPDIVMTQTPLTLSVTIGQPASISCKSSQSLLDSDGKTYLNWLLQRPGQSPERLIYLVSKLDSGVPDRFTGSGSGTDFTLKISRVEAEDLGVYCCWQGTHFPYTFGGGTKVEIKGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPGQGLEWIGMIDPSDSETHYNHIFKDKATLTVDKSSSTAYLQLSSLTSEDSAVYYCARNLYLWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9866 - protein, 631 aa, Artificial Sequence
  Synthetic Polypeptide
MALPVTALLLPLALLLHAARPDIVMTQSPDSLAVSLGERATINCESSQSLLNSGNQKNYLTWYQQKPGQPPKPLIYWASTRESGVPDRFSGSGSGTDFTLTISSLQAEDVAVYYCQNDYSYPYTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTDYYMKWARQMPGKGLEWMGDIIPSNGATFYNQKFKGQVTISADKSISTTYLQWSSLKASDTAMYYCARSHLLRASWFAYWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9867 - protein, 626 aa, Artificial Sequence
  Synthetic Polypeptide
MALPVTALLLPLALLLHAARPDIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9868 - protein, 621 aa, Artificial Sequence
  Synthetic Polypeptide
MALPVTALLLPLALLLHAARPDIQMTQSPASLSVSVGETVTITCRASENIYSNLAWYQQKQGKSPQLLVYAATNLADGVPSRFSGSGSGTQYSLKINSLQSEDFGSYYCQHFWGTWTFGGGTTLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASVKMSCKASGYTFTDYYMKWMKQSHGKSLEWIGDINPNNGGTTYNQKFKGKATLTVDKSSSTAYMQLNSLTSEDSAVYYCARDYGYGYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9869 - protein, 624 aa, Artificial Sequence
  Synthetic Polypeptide
MALPVTALLLPLALLLHAARPEIVLTQSPGTLSLSPGERATLSCRASQSVGGYLAWYQQKPGQAPRLLIYDASNRATGIPARFSGSGSGTDFTLTISSLEPEDFAVYYCQQRNNWPPMYTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPILGTANYAQKFQGRVTITADESTSTAYMELSSLRSEDTAVYYCARWGGGAFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9870 - protein, 619 aa, Artificial Sequence
  Synthetic Polypeptide
MALPVTALLLPLALLLHAARPQIVLTQSPALMSASPGEKVTMTCSASSSVRYMYWYQQKPRSSPKPWIHLTSNLASGVPARFSGSGSGTSYSLTISSMEAEDAATYYCQQWSSHPFTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEDVQLQESGPGLVKPSQSLSLTCTVTGFSITSDYSWNWIRQFPGNKLEWMGYISYSGHTSYNPSLESRISITRDTSKNQFFLQLNSVTTEDTATYYCTRGNWDVVYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9871 - protein, 629 aa, Artificial Sequence
  Synthetic Polypeptide
MALPVTALLLPLALLLHAARPDVVMTQSPLSLPVTLGQPASISCRSSQSIVHSDGNTYLEWYQQRPGQSPRRLIYKVSNRFSGVPDRFSGSGSGTDFTLKISRVEAEDVGVYYCFQGSHAPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSSYGMHWVRQAPGKGLEWVAYITTRSSTIYYADSVKGRFTISRDNAKNSLYLQMNSLRAEDTAVYYCTREPLTGYYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9872 - protein, 621 aa, Artificial Sequence
  Synthetic Polypeptide
MALPVTALLLPLALLLHAARPDIQMTQSPSSLSASVGDRVTITCRASQSISLWLNWYQQKPGKAPKLLIYAASTLQSGVPSRFSGSGSGTDFTLTISSLQPEDFATYYCQQYYTSPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLLESGGGLVQPGGSLRLSCAASGFTFSSYAMSWVRQAPGKGLEWVSVIRSSGSSTYYADSVKGRFTISRDNSKNTLYLQMNSLRAEDTAVYYCARGGGYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9873 - protein, 624 aa, Artificial Sequence
  Synthetic Polypeptide
MALPVTALLLPLALLLHAARPDIQMTQSPSSLSASVGDRVTITCRASQSISSYLNWYQQKPGKAPKLLIYAVSTLQSGVPSRFSGSGSGTDFTLTISSLQPEDFATYYCQQSGTFPPTTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLLESGGGLVQPGGSLRLSCAASGFTFSSHGMHWVRQAPGKGLEWVSVISGSGSNTGYADSVKGRFTISRDNSKNTLYLQMNSLRAEDTAVYYCARQWGSYAFDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9874 - protein, 634 aa, Artificial Sequence
  Synthetic Polypeptide
MALPVTALLLPLALLLHAARPDIVMSQSPSSLAVSVGEKVTMSCKSSQSLLHSSNQKNYLAWYQQKPGQSPKVLIYWASTRESGVPDRFTGSGSGTDFTLTITSVKSEDLAVYYCQQYYSYPWTFGGGTRLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSVAELVKPGASVKMSCKVSGYTLTDHTIHWMKQRPEQGLEWIGYIYPRDGITGYNEKFKGKATLTADTSSSTAYMQLNSLTSEDSAVYFCARWGYSYRNYAYYYDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9875 - protein, 631 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9876 - protein, 623 aa, Artificial Sequence
  Synthetic Polypeptide
MALPVTALLLPLALLLHAARPDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9877 - protein, 616 aa, Artificial Sequence
  Synthetic Polypeptide
MALPVTALLLPLALLLHAARPMTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9878 - protein, 621 aa, Artificial Sequence
  Synthetic Polypeptide
MALPVTALLLPLALLLHAARPQSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9879 - protein, 624 aa, Artificial Sequence
  Synthetic Polypeptide
MALPVTALLLPLALLLHAARPDIQMTQSPSSLSASLGERVSLTCRATQELSGYLSWLQQKPDGTIKRLIYAASTLDSGVPKRFSGNRSGSDYSLTISSLESEDFADYYCLQYAIYPYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASVKMSCKASGYTFTSYFIHWVKQKPGQGLEWIGFINPYNDGSKYNEKFKGKATLTSDKSSSTAYMELSSLTSEDSAVYYCTRDDGYYGYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9880 - protein, 629 aa, Artificial Sequence
  Synthetic Polypeptide
MALPVTALLLPLALLLHAARPDTIVLTQSPASLAVSLGQRATISCRASESVDSYGNSFMHWYQQKPGQPPKLLIYLASNLESGVPARFSGSGSRTDFTLTIDPVEADDAATYYCQQNNYDPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASVKMSCKASGYTFTSYVMHWVKQKPGQGLEWIGYINPYNDGTKYNEKFKGKATLTSDTSSSTAYMELNSLTSEDSAVYFCARPIYFDNDYFDYWGQGTTLKVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9881 - protein, 626 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGPDLKKPGETVKISCKASGYTFTNTGMNWVKQAPGKGLKWMGWINTYTGEPTYADDFKGRFTFSLETSASTAYLQINNLKNEDTATYFCTRWGYGSSLYYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9882 - protein, 624 aa, Artificial Sequence
  Synthetic Polypeptide
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9883 - protein, 624 aa, Artificial Sequence
  Synthetic Polypeptide
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYSFTTYWMNWVKQRPGQGLEWIGMIHPSDSETRLNQKFKDKATLTVDKSSSTAYMQLSSPTSEDSAVYYCARSTMIATRAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9884 - protein, 630 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9885 - protein, 630 aa, Artificial Sequence
  Synthetic Polypeptide
MALPVTALLLPLALLLHAARPQSVLTQPPSVSGAPGQRVTISCTGSGSNIGAPYDVSWYQQLPGTAPKLLIYHNNKRPSGVPDRFSGSKSGTSASLAITGLQAEDEADYYCQSYDSSSISTIFGGGTKLTVLGALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSGIAYRPWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9886 - protein, 628 aa, Artificial Sequence
  Synthetic Polypeptide
MALPVTALLLPLALLLHAARPDIQMTQSPSSLSASVGDRVTITCSASSSVSYMYWYQQKPGKAPKLLIYLTSNLASGVPSRFSGSGSGTDFTLTISSLQPEDFATYYCQQWRSNPFTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQITLKESGPTLVKPTQTLTLTCTFSGFSLSTSGMGVGWIRQPPGKALEWLAHIWWDDVKRYSPSLKSRLTITKDTSKNQVVLTMTNMDPVDTATYYCARIVSFDNDVVSAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9887 - protein, 623 aa, Artificial Sequence
  Synthetic Polypeptide
MALPVTALLLPLALLLHAARPEIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9888 - protein, 618 aa, Artificial Sequence
  Synthetic Polypeptide
MALPVTALLLPLALLLHAARPDIQMTQSPSSLSASVGDRVTITCRASQGIRNNLAWYQQKPGKAPKRLIYAASNLQSGVPSRFTGSGSGTEFTLIVSSLQPEDFATYYCLQHHSYPLTSGGGTKVELEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQVLESGGGLVQPGGSLRLSCAASGFTFSSYAMSWVRQAPGKGLEWVSAISGSGGSTNYADSVKGRFTISRDNSKNTLYLQMNSLRAEDTAVYYCAGSSGWSEYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9889 - protein, 624 aa, Artificial Sequence
  Synthetic Polypeptide
MALPVTALLLPLALLLHAARPDEIQLVQSGAEVKKPGESLRISCKGSGFNIEDYYIHWVRQMPGKGLEWMGRIDPENDETKYGPIFQGHVTISADTSINTVYLQWSSLKASDTAMYYCAFRGGVYWGQGTTVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEDVVMTQSPDSLAVSLGERATINCKSSQSLLDSDGKTYLNWLQQKPGQPPKRLISLVSKLDSGVPDRFSGSGSGTDFTLTISSLQAEDVAVYYCWQGTHFPGTFGGGTKVEIKTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9890 - protein, 631 aa, Artificial Sequence
  Synthetic Polypeptide
MALPVTALLLPLALLLHAARPDELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9891 - protein, 632 aa, Artificial Sequence
  Synthetic Polypeptide
MALPVTALLLPLALLLHAARPDELQMTQSPSSLSASVGDRVTITCRASQSISSYLNWYQQKPGQPPKLLIYWASTRESGVPDRFSGSESGTNYTLTISSLQPEDFATYFCQQSDSLPITFGQGTRLDIQLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9892 - protein, 629 aa, Artificial Sequence
  Synthetic Polypeptide
MALPVTALLLPLALLLHAARPDDIQMTQSPSSLSASVGDRVTITCRASQSISSYLNWYQQKPGKAPKLLIYAASSLQSGVPSRFSGSGSGTDFTLTISSLQPEDLATYYCQQSYSTPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVHEVQLVQSGAEVKKPGSSVKVSCKASGGTFSSYAISWVRQAPGQGLEWMGGIIPIFGTANYAQKFQGRVTITADKSTSTAYMELSSLRSEDTAVYYCATFALFGFREQAFDIWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9893 - protein, 626 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRFSGVPDRFSGSGSGTDFTLKISRVEAEDLGVYFCSQSTHVPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVKLDETGGGLVQPGRPMKLSCVASGFTFSDYWMNWVRQSPEKGLEWVAQIRNKPYNYETYYSDSVKGRFTISRDDSKSSVYLQMNNLRVEDMGIYYCTGSYYGMDYWGQGTSVTVSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9894 - protein, 627 aa, Artificial Sequence
  Synthetic Polypeptide
MALPVTALLLPLALLLHAARPDIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9895 - protein, 624 aa, Artificial Sequence
  Synthetic Polypeptide
MALPVTALLLPLALLLHAARPDDVVMTQTPLSLPVTPGEPASISCRSSQSLVHRNGNTYLHWYLQKPGQSPKLLIHKVSNRFSGVPDRFSGSGSGTDFTLKISRVEAEDLGVYFCSQSTHVPPLTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVEKPGASVKISCKASGSSFTGYNMNWVRQNIGKSLEWIGAIDPYYGGTSYNQKFKGRATLTVDKSTSTAYMHLKSLRSEDTAVYYCVSGMEYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9896 - protein, 622 aa, Artificial Sequence
  Synthetic Polypeptide
MALPVTALLLPLALLLHAARPDEIVMTQTPATLSVSAGERVTITCKASQSVSNDVTWYQQKPGQAPRLLIYSASNRYSGVPARFSGSGYGTEFTFTISSVQSEDFAVYFCQQDYSSFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGPGVVQPGRSLRISCAVSGFSVTNYGVHWVRQPPGKGLEWLGVIWAGGITNYNSAFMSRLTISKDNSKNTVYLQMNSLRAEDTAMYYCASRGGHYGYALDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9897 - protein, 624 aa, Artificial Sequence
  Synthetic Polypeptide
MALPVTALLLPLALLLHAARPDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9898 - protein, 626 aa, Artificial Sequence
  Synthetic Polypeptide
MALPVTALLLPLALLLHAARPQFVLTQSPSASAALGASAKLTCTLSSAHKTYTIDWYQQQKGKAPRYLIQVKSDGTYTKATGVPDRFSGSSSGADRYLIIPSVQADDEADYYCGTDYTGGYVFGGGTQLTVTLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEQLKESGGGLFKPTDTLTLTCTVSGFSLSYYGVNWVRQAPGNGLEWIGTIGGSGDTYYASWAKSRSTIIRNTNENTVTLKMTSLTAADTATYFCVRYANIGYEYFNVWGPGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9899 - protein, 631 aa, Artificial Sequence
  Synthetic Polypeptide
MALPVTALLLPLALLLHAARPQFVLTQSPSVSAALGASAKLTCTLSSAHKTYTIDWYQQQQGEAPRYLMQVKSDGSYTKGTGVPDRFSGSSSGADRYLIIPSVQADDEAGYVCGADDNGGYVFGGGTQLTVTLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQSVKESEGGLFKPTDTLTLTCTVSGFSLSRHALTWVRQAPGNGLEWIGAIDNAGTTYYASWAKSRSTITRNTDLHTVTLKMTSLTASDTATYFCARVFYDINSGYYLDGMDLWGPGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9900 - protein, 625 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGESLRLSCVASGFTFSRYKMNWVRQAPGKGLEWVSYISRSGRDIYYADSVKGRFTISRDNAKNSLYLQMNSLRDEDTAVYYCAGTVTTYYYFGMDVWGHGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9901 - protein, 626 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGSVQPGESLRLSCVASGFTFSRYKMNWVRQAPGKGLEWVSYISRSGRDIYYADSVKGRFTISRDNAKNSLYLQMNSLRDEDTAVYYCAGTVTTYYYDFGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9902 - protein, 624 aa, Artificial Sequence
  Synthetic Polypeptide
MALPVTALLLPLALLLHAARPQSVLTQPPSASGTPGQRVTISCSGSRSNVGGNYVFWYQQVPGATPKLLIYRSNQRPSGVPDRFAGSKSGSSASLAISGLRSEDEADYYCATWDDSLSGFVFGTGTKVTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVESGGGLVKPGGSLRLSCAASGFTFSDYYMSWIRQAPGKGLEWVSYISSSGSTIYYADSVKGRFTISRDNAKNSLYLQMNSLRAEDTAVYYCARGYGKAYDQWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9903 - protein, 623 aa, Artificial Sequence
  Synthetic Polypeptide
MALPVTALLLPLALLLHAARPQSVVTQPPSMSAAPGQQVTISCSGGNSNIERNYVSWYLQLPGTAPKLVIFDNDRRPSGIPDRFSGSKSGTSATLGITGLQTGDEADYYCGTWDSSLRGWVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVESGGGLIQPGGSLRLSCAASGFTFSNYAMNWVRQAPGKGLEWVSTINGRGSSTIYADSVKGRFTISRDNSKNTLYLQMNSLRAEDTATYYCARYISRGLGDSWGQGTLVTVTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9904 - protein, 624 aa, Artificial Sequence
  Synthetic Polypeptide
MALPVTALLLPLALLLHAARPDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQNTPVPPKFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELVRPGASVKLSCKASGYTFNDYEMHWVKQTPVHGLKWIGALEPKTGDTAYSQKFKGKATLTADKSSSTAYMELRSLTSEDSAVYYCTSCYYYTYSGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9905 - protein, 623 aa, Artificial Sequence
  Synthetic Polypeptide
MALPVTALLLPLALLLHAARPDIQLTQSPSSLSASVGDRVTITCRASQGIRNDLGWYQQKPGKAPKRLIYAASSLQNGVPSRFSGSGSGTEFTLTISSLQPEDFATYYCLQHNTYPAFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9906 - protein, 624 aa, Artificial Sequence
  Synthetic Polypeptide
MALPVTALLLPLALLLHAARPDIQMTQSPSSLSASVGDRVTITCRASQDVNTAVAWYQQKPGKAPKLLIYSASFLESGVPSRFSGSRSGTDFTLTISSLQPEDFATYYCQQHYTTPPTFGQTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9907 - protein, 631 aa, Artificial Sequence
  Synthetic Polypeptide
MALPVTALLLPLALLLHAARPDIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGPTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9908 - protein, 637 aa, Artificial Sequence
  Synthetic Polypeptide
MALPVTALLLPLALLLHAARPQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9909 - protein, 622 aa, Artificial Sequence
  Synthetic Polypeptide
MALPVTALLLPLALLLHAARPEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9910 - protein, 632 aa, Artificial Sequence
  Synthetic Polypeptide
MALPVTALLLPLALLLHAARPELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEILEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFELEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9911 - protein, 612 aa, Artificial Sequence
  Synthetic Polypeptide
MALPVTALLLPLALLLHAARPDIQMTQSPSSLSASVGDRVTITCQASQDINNYLNWYQQKPGKAPKLLIYDASNLQTGVPSRFSGSGSGTDFTFTIEDIATYYCQQYTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSWYSMTWVRQAPGKGLEWVSSIVPWGDFTQYADSVKGRFTISRDNSKNTLYLQMNSLRAEDTAVYYCAKGPGWGSFDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9912 - protein, 758 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9913 - protein, 622 aa, Artificial Sequence
  Synthetic Polypeptide
MALPVTALLLPLALLLHAARPDIQMTQSPSSLSASVGDRVTITCTASLSVSSTYLHWYQQKPGSSPKLWIYSTSNLASGVPSRFSGSGSGTSYTLTISSLQPEDFATYYCHQYHRSPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFSLTKYGVHWVRQAPGKGLEWVGVKWAGGSTDYNSALMSRFTISKDNAKNSLYLQMNSLRAEDTAVYYCARDHRDAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9914 - protein, 626 aa, Artificial Sequence
  Synthetic Polypeptide
MALPVTALLLPLALLLHAARPDIQMTQSPSSLSASVGDRVTITCKASQDVGTAVAWYQQKPGKAPKLLIYSASYRSTGVPSRFSGSGSGTDFTLTISSLQPEDFATYYCQHHYSAPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSRNGMSWVRQAPGKGLEWVATVSSGGSYIYYADSVKGRFTISRDNAKNSLYLQMNSLRAEDTAVYYCARQGTTALATRFFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9915 - protein, 622 aa, Artificial Sequence
  Synthetic Polypeptide
MALPVTALLLPLALLLHAARPDIQMTQSPPSLSASVGGKVTITCKASQDIDRYMAWYQDKPGKGPKLLIHDTSTLQPGIPSRFSGSGSGRDYSFSISNLEPEDIATYYCLQYDNLWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAELVKPGASVKMSCKASGYIFTNYNIHWVKKSPGQGLEWIGAIYPGNGDAPYSQKFQDRATLTADTSSSTTYMELSSLTSEDSAVYYCVRANWDVAFAYWGQGTLVSVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9916 - protein, 623 aa, Artificial Sequence
  Synthetic Polypeptide
MALPVTALLLPLALLLHAARPDIQMTQSPASLSASVGETVTITCRVSGNIHNYLAWYQQKQGKSPQLLVYNAKTLADGVPSRFSGSGSGTQYSLKINSLQPEDFGSYYCQHFWSNPYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGASVKVSCKASELVRPGTGYAFTNYLIEWVKQRPGQGLEWIGVINPGSGGTNYNEKFKGKATLTADKSSSTAYMQLSSLTSDDSAVYFCARYRSYDWYFDVWGAGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9917 - protein, 628 aa, Artificial Sequence
  Synthetic Polypeptide
MALPVTALLLPLALLLHAARPDDIQMTQSPSSLSASVGDRVTITCRSSQRIVHSNGNTYLEWYQQTPGKAPKLLIYKVSNRFSGVPSRFSGSGSGTDYTPTISSLQPEDIATYYCFQGSHVPPTFGQGTKLQITLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGVVQPGRSLRLSCSSSGPTFSDYYMYWVRQAPGKGLEWVAYMSNVGAITDYPDTVKGRPTISRDNSKNTLFLMDSLRPEDTGVYFCARGTRDGSWFAYWGQGTPVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9918 - protein, 622 aa, Artificial Sequence
  Synthetic Polypeptide
MALPVTALLLPLALLLHAARPDIQMTQSFSSLSASVGDRVTITCRASQDISNYLNWYQQKPGKAPKLLIYYTSRLHSGVPSRFSGSGSGTDYTLTISSLQPEDFATYFCQQGNTLPWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGGGLVQSGGSLRLSCRASGYTFTRYWMLWVRQRPGKGLEWVAEINPRNDRTNYNEKFKTRFTISVDRSKNTLYLQMDSLRAEDTAVYFCALGGGYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9919 - protein, 623 aa, Artificial Sequence
  Synthetic Polypeptide
MALPVTALLLPLALLLHAARPDIQMTQSPASLSASVGETVTIICRASVNIYSYLAWYQQKQGKSPQLLVYNAKILAEGVPSRFSGSGSGTQFSLKINSLQPEDFGSYYCQHHYGTFTFGSGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLKESGPGLVAPSQSLSITCTISGFSLTSYGVHWVRQPPGKGLEWLVVIWSDGSTTYNSALKSRLSISKDNSKSQVFLKMNSLQTDDTAIYYCASHYGSTLAFASWGHGTLVTVSAATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9920 - protein, 631 aa, Artificial Sequence
  Synthetic Polypeptide
MALPVTALLLPLALLLHAARPDIVMTQSHKFMSTSVGDRVSVTCKASQNVGNNVAWYQQKPGQSPKVLIYSASYRYSGVPDRFTGSGSGTDFTLTISNVQSEDLAEYFCQQYNTYPFTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLEESGGGLVQPGGSMKLSCVASGFTFSNYWMNWVRQSPEKGLEWVAEIRFKSHNYATHFAESVKGRFTISRDDSKSSVYLQMNNLRAEDTGIYYCTRRIGNSDYDWWYFDVWGAGTSVTVSSASTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9921 - protein, 627 aa, Artificial Sequence
  Synthetic Polypeptide
MALPVTALLLPLALLLHAARPDDIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9922 - protein, 624 aa, Artificial Sequence
  Synthetic Polypeptide
MALPVTALLLPLALLLHAARPDIQMTQSPSSLSASVGDRVTITCRASQSISSYLNWYQQKPGKAPKLLIYAASSLQSGVPSGFSGSGSGTDFTLTISSLQPEDFATYYCQQSYSTPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSVSSGSYYWSWIRQPPGKGLEWIGYIYYSGSTNYNPSLKSRVTISVDTSKNQFSLKLSSVTAADTAVYYCAREGKNGAFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9923 - protein, 624 aa, Artificial Sequence
  Synthetic Polypeptide
MALPVTALLLPLALLLHAARPDQIVLTQSPAIMSASPGEKVTISCSASSSVSYMYWYQQKPGSSPKPWIYRTSNLASGVPARFSGSGSGTSYSLTISNMEAEDAAAYYCQQYHSYPTTFGGGTKLEVKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPKGSLKLSCAASGFSFNTYAMNWVRQAPGKGLEWIAHIRSKSNNFATYYADSVKDRFSISRDASENILFLQMNNLKTEDTAMYYCVRQGGDFPMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9924 - protein, 623 aa, Artificial Sequence
  Synthetic Polypeptide
MALPVTALLLPLALLLHAARPDDIQMTQSSSSFSVSLGDRVTITCMASEDIYIRLAWYQQKPGNAPRLLISAATSLETGVPSRFSGSGSGKDYTLSITSLQTEDVGTYYCQQYWSSPWTFGGGTKLEINLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEDVQLQESGPGLVKPSQSLSLTCTVTGYSITSDYTWNWIRQFPGNKLEWMGYITYSGSTSYNPSLKSRNSITRDTSKNQFFLQLNSVTTEDTATYYCARLGRRYTMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9925 - protein, 623 aa, Artificial Sequence
  Synthetic Polypeptide
MALPVTALLLPLALLLHAARPDIQMTQSSSSFSVSLGDRVTITCKASEDIYIRLAWYQQKPGNAPRLLISAATSLETGIPSRFSGSGSGEDYTLTITSLQTEDVATYYCQQYWTTPWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEDVQLQESGPGLVKPSQSLSLTCTVTGYSITIDYTWNWIRQFPGNKLEWMGYITYSGSTDYNPSLKSRSSITRDTSMNQFFLQLNSVTTEDTATYYCARLGRRYALDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9926 - protein, 627 aa, Artificial Sequence
  Synthetic Polypeptide
MALPVTALLLPLALLLHAARPDEIVMTQSPATLSLSPGERATLSCRASQSVSSYLAWYQQKPGQAPRLLIYDASNRATGIPARFSGSGSGTDFTLTISSLEPEDFAVYYCHQYGSSPQTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCAVHYGDYVFSSMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9927 - protein, 630 aa, Artificial Sequence
  Synthetic Polypeptide
MALPVTALLLPLALLLHAARPDETTLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGPEYCINGVCSLDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9928 - protein, 632 aa, Artificial Sequence
  Synthetic Polypeptide
MALPVTALLLPLALLLHAARPDIELTQSPSSLAVSAGEKVTMSCKSSQSLLNSRTRKNQLAWYQQKPGQSPELLIYWASTRQSGVPDRFTGSGSGTDFTLTISSVQAEDLAVYYCQQSYNLLTFGPGTKLEVKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVKLQESGGGFVKPGGSLKVSCAASGFTFSSYAMSWVRLSPEMRLEWVATISSAGGYIFYSDSVQGRFTISRDNAKNTLHLQMGSLRSGDTAMYYCARQGFGNYGDYYAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9929 - protein, 631 aa, Artificial Sequence
  Synthetic Polypeptide
MALPVTALLLPLALLLHAARPDIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQILEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAEVKKPGSSVKVSCKASGYTFTNYYIYWVRQAPGQGLEWIGGINPTSGGSNFNEKFKTRVTITADESSTTAYMELSSLRSEDTAFYFCTRQGLWFDSDGRGFDFWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9930 - protein, 621 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVHLQESGPGLVKPSETLSLTCTVSDDSISSYYWSWIRQPPGKGLEWIGHISYSGSANYNPSLKSRVTISVDTSKNQFSLKLSSVTAADTAVYYCANWDDAFNIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9931 - protein, 623 aa, Artificial Sequence
  Synthetic Polypeptide
MALPVTALLLPLALLLHAARPDVVMTQTPLTLSVTIGQPASISCKSSQSLLDSDGKTYLHWLLQRPGQSPKRLIFLVSKLDSGVPDRFTGSGSGTDFTLKISRVEAEDLGVYYCWQGTHFPQTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLQESGPDLVKPSQSLSLTCTVTGYSITSGYSWHWIRQFPGNKLEWMGYIHYSGDTDYNPSLKSRFSITRDTSKNQFFLQLNSVTTEDTATYYCATPGGFVYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9932 - protein, 625 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLLESGGGLVQPGGSLRLSCAASGFTFSTYQMSWVRQAPGKGLEWVSGIVSSGGSTAYADSVKGRFTISRDNSKNTLYLQMNSLRAEDTAVYYCAGELLPYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9933 - protein, 626 aa, Artificial Sequence
  Synthetic Polypeptide
MALPVTALLLPLALLLHAARPDQSELTQPRSVSGSPGQSVTISCTGTERDVGGYNYVSWYQQHPGKAPKLIIHDVIERSSGVPDRFSGSKSGNTASLTISGLQAEDEADYYCWSFAGGYYVFGTGTDVTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSTYEMHWVRQAPGKGLEWVSVILSSGGETNYADSVKGRFTISRDNSKNTLYLQMNSLRAEDTAVYYCAGMLLPYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9934 - protein, 622 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9935 - protein, 641 aa, Artificial Sequence
  Synthetic Polypeptide
MALPVTALLLPLALLLHAARPDDIVMTQSPLSLPVTPGEPASISCRSSQSLLHSNGYNYLVWYLQKPGQSPQLLIYLGSIRASGVPDRFSGSGSGTDFTLKISRVEAEDVGVYYCMQPLQTPITFGQGTRLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEGLQCVAAPRWVLSQVQLQQWGAGLLKPSETLSLTCAVYGGSFSGNYWSWIRQPPGKGLEWIGEINHSGSTNYNPSLKSRVTISVDTSKNQFSLKLSSVTAADTAVYYCARGGSYNYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9936 - protein, 638 aa, Artificial Sequence
  Synthetic Polypeptide
MALPVTALLLPLALLLHAARPDQLTQSPSSVSASVGDRVTITCRASRGISSWLAWYQQKPGKAPKLLIYTASSLQSGVPSRFSGSGSGTDFTLTISSLQPEDFATYYCQQAYSFPRTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVAAPRWVLSQVQLQESGPGLVKPSQTLSLTCTVSGGSISSGGYYWIWIRQHPGKGLEWIGYIYYNGNTYYNPSLKSRVTMSVDTSKNQFSLKLSSVTAADTAVYYCARDGITMIRGYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9937 - protein, 612 aa, Artificial Sequence
  Synthetic Polypeptide
MALPVTALLLPLALLLHAARPDIVVTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVKLEESGGDLVKPGGSLKLSCAASGFTFSGYGMSWVRQTPDKRLEWVATISSGGSYTYYPDSVKGRFTISRDNAKNTLYLQMSSLKSEDTAMYYCARHEGGYYGSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9938 - protein, 628 aa, Artificial Sequence
  Synthetic Polypeptide
MALPVTALLLPLALLLHAARPDDIQMTQSPSSLSASVGDRVTITCRASQGISNYLAWYQQKTGKVPKFLIYEASTLQSGVPSRFSGGGSGTDFTLTISSLQPEDVATYYCQNYNSAPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFAFSRYGMHWVRQAPGKGLEWVAVIWYDGSNKYYADSVKGRFTISRDNSKNTQYLQMNSLRAEDTAVYYCARGGDFLYYYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9939 - protein, 619 aa, Artificial Sequence
  Synthetic Polypeptide
MALPVTALLLPLALLLHAARPDIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9940 - protein, 620 aa, Artificial Sequence
  Synthetic Polypeptide
MALPVTALLLPLALLLHAARPDIQMTQSPSSLSASVGDRVTITCKASQDIYPYLNWFQQKPGKAPKTLIYRTNRLLDGVPSRFSGSGSGTDFTFTISSLQPYYCLQYDEFPLTFGAGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQITLKESGPTLVKPTQTLTLTCTFSGFSLSTSNMGVGWIRQPPGKALEWLAHIWWDDDKYYSPSLKSRLTITKDTSKNQVVLTMTNMDPVDTATYYCVRSNYGYAWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9941 - protein, 620 aa, Artificial Sequence
  Synthetic Polypeptide
MALPVTALLLPLALLLHAARPDIVMTQSQKFMSTSVGDRVNVTCKASQNVGTNVVWYQQKTGQSPKALIHSASYRYSGVPDRFTGSGSGTDFTLTLSNVQSEDLAEYFCQHYNSFPYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELVRPGVSVKISCKGSGYRFTDYPIHWVKQSHAKSLEWIGIISTYYGDVTNNPKFRGKATMTVDKSSTTAYMELARLTSEDSAIYYCARNDLFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9942 - protein, 631 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTDFTLTISSLQSVDSAVYYCQQYNNWPPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLLESGGGVVQPGRSLRLSCAASGFTFSFYGMHWVRQAPGKGLEWVAAISYDGSNKYYADSVKGRFTISRDNSKNTLYLQMNSLRAEDTAVYYCAKRPNQFYCSDGRCYSIDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9943 - protein, 627 aa, Artificial Sequence
  Synthetic Polypeptide
MALPVTALLLPLALLLHAARPQSVLTQPPSASAGGTPGQRVTISCSGSSSNIGSNFVYWYQQLPGTAPKLLIYRNNQRPSGVPDRFSGSRSGTSASLAGLRSEDEADYYCAADSLGGHYVFGTGTKVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGSVQPGRSLRLSCEASGFTFEAYAMHWVRQPPGKGLEWVSSINWNSGRIAYADSVKGRFTISRDNARNSLYLQMNSLRLEDTAFYYCAKDIRRFSTGGAEFEYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9944 - protein, 622 aa, Artificial Sequence
  Synthetic Polypeptide
MALPVTALLLPLALLLHAARPENVLTQSPAIMSASPGEKVTMTCSASSSVSYMHWYQQKSSTSPKLWIYDTSKLASGVPGRFSGSGSGNSYSLTISSMEAEDVATYYCFQGSGYPLTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLKESGPGLVAPSQSLSITCTVSGFSLSSQGVYWVRQPPGKGLEWLGAIWAGGSTNYNSALMSRLSISKDNSKSQVFLKMNSLQTDDTAMYYCARVDGYRGYNMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9945 - protein, 626 aa, Artificial Sequence
  Synthetic Polypeptide
MALPVTALLLPLALLLHAARPDDIQMTQSPSSLSASVGDRVTITCRASQSISSYLNWYQQKPGKAPKLLIYDASNLETGVPSRFSGSGSGTDFTFTISSLQPEDIATYYCQQYDNLPLTFGGGTKVDIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARAHNSSSWSFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9946 - protein, 635 aa, Artificial Sequence
  Synthetic Polypeptide
MALPVTALLLPLALLLHAARPDDVVMTQSPLSLPVSLGDQASISCRSSQRLVHSNGNTYLHWYLQKPGQSPKLLIYRVSNRFPGVPDRFSGSGSGTDFTLKISRVEAEDLGIYFCSQSTHVPYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVRLQQSGPDLIKPGASVKMSCKASGYTFTGYVMHWVKQRPGQGLEWIGFINPYNDDIQSNERFRGKATLTSDKSSTTAYMELSSLTSEDSAVYYCARGAGYNFDGAYRFFDFWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9947 - protein, 626 aa, Artificial Sequence
  Synthetic Polypeptide
MALPVTALLLPLALLLHAARPDSYELTQPPSVSVSPGQTATISCSGDQLGGKYGHWYQKKPGQSPVLVLYQDRKRPAGIPERFSGSSSGNTITLTISGTQAVDEADYYCQAWDTNLGGVFGGGTKVTVLGQLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGAEVKKPGASVKVSCKASGYTFTGYYMHWVRQAPGQGLEWMGRINPNSGGTNYAQKFQGRVTMTRDTSISTAYMELSRLRSDDTAVYYCASPRGRGSAFDIWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9948 - protein, 629 aa, Artificial Sequence
  Synthetic Polypeptide
MALPVTALLLPLALLLHAARPDNFMLTQPHSVSESPGKTVTISCTRSSGSIASKYVQWYQQRPGSSPTTVIYEDNQRPSGVPDRFSGSIDTSSNSASLTISGLRTEDEADYYCHSYDSNNHSVFGGGTKVTVLGQLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGVVQPGGSLRLSCAASGFTFSSYAMSWVRQAPGKGLEWVSAISGSGGSTYYADSVKGRFSISRDNSKNTLYLQMNSLRAEDTAVYYCARTRSSGAFDIWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9949 - protein, 624 aa, Artificial Sequence
  Synthetic Polypeptide
MALPVTALLLPLALLLHAARPDIQMNQSPSSLSASLGDTITITCHASQNINVWLSWYQQKPGNIPKLLIYKASNLHTGVPSRFSGSGSGTGFTITISSLQPEDIATYYCQQGQSYPWTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASVKISCKASGYSFTGYFMNWVKQSHGKSLEYIGRFNPYNGETLYNQKFKGKATLTVDKSSSTVHMELLSVTSEDSAVYYCGRSGNDDAMDYWGQGTSVTVSSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9950 - protein, 625 aa, Artificial Sequence
  Synthetic Polypeptide
MALPVTALLLPLALLLHAARPEIVLTQSPATLSLSPGERATLSCRASQSVRSYLAWYQQKPGQAPRLLIYDASNRATGIPARFSGSGSGTDFTLTISSLEPEDFAVYYCQQRSNWPPTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQLQVQESGPGLVKPSETLSLTCTVSGGSISNSYFSWGWIRQPPGKGLEWIGSFYYGEKTYYNPSLKSRATISIDTSKSQFSLKLSSVTAADTAVYYCPRGPTMIRGVIDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9951 - protein, 634 aa, Artificial Sequence
  Synthetic Polypeptide
MALPVTALLLPLALLLHAARPDIVMTQTPLSLPVTPGEPASISCRSSRSLLDSDDGNTYLDWYLQKPGQSPQLLIYTLSYRASGVPDRFSGSGSGTDFTLKISRVEAEDVGVYYCMQRVEFPITFGQGTRLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFIFSRYGMHWVRQAPGKGLKWVAVIWYDGSNKLYADSVKGRFTISRDNSKNTLYLQMNSLRAEDTAVYYCARDYYDNSRHHWGFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9952 - protein, 624 aa, Artificial Sequence
  Synthetic Polypeptide
MALPVTALLLPLALLLHAARPEIQMTQSPSSMSASLGDTITITCQATQDIFKNLNWYQQKPGKPPSLLIYYATELAEGVPSRFSGSGSGSDYSLTISNLESEDFAAYYCLQFFEFPFTFGSGTKLEMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELVRPGTSVKVSCKASGYVFTNYWIEWIKQRPGQGLEWIGVMNPGSGETTYNEKFKGKATLTADKSSSTAYMQLSSLTSVDSAVYFCARDHDRDYYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9953 - protein, 621 aa, Artificial Sequence
  Synthetic Polypeptide
MALPVTALLLPLALLLHAARPDILLTQSPAILSVSPGERVSFSCRASQNIGTSIHWYQQRTNGSPRLLIKYASESVSGIPSRFSGSGSGTDFTLSINSVESEDIADYYCQHTNSWPTTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSDAELVKPGASVKISCKASGYTFTDHAIHWVKQKPEQGLEWIGYFSPGNGDIKYNEKFKGKATLTADKSSSTAYMQLNSLTSEDSAVYFCKRSYGNYDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9954 - protein, 626 aa, Artificial Sequence
  Synthetic Polypeptide
MALPVTALLLPLALLLHAARPDIVMTQSPDSLAVSLGERATINCKSSQSLLNSGDQKNYLTWYQQKPGQPPKLLIYWASTRESGVPDRFSGSGSGTDFTLTISSLQAEDVAVYYCQNDYSYPLTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKTGSSVKVSCKASGYTFTDHAIHVWRQAPGQALEWMGHFSPGNTDIKYNDKFKGRVTLTVDRSMSTAYMELSSLRSEDTAMYYCKTSTFFFDYWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9955 - protein, 625 aa, Artificial Sequence
  Synthetic Polypeptide
MALPVTALLLPLALLLHAARPDIQMTQSPSSLSASVGDRVTITCKASQDVSIAVAWYQQKPGKAPKVLIYSASYRYTGVPDRFSGSGSGTDFTFTISSLQPEDIAVYYCQQHYITPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGHEVKKPGASVKVSCKASGYTFTNYGMNWVRQAPGQGLEWMGWINTKTGEPTYAEEFKGRFVFSLETSASTAYLQISSLKAEDTAMYFCGRGGYGSSYWYFDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9956 - protein, 627 aa, Artificial Sequence
  Synthetic Polypeptide
MALPVTALLLPLALLLHAARPDIVMTQSPDSLAVSLGERATINCRASKSVSTSGYSYMHWYQQKPGQPPKLLIYLASNLESGVPDRFSGSGSGTDFTLTISSLQAEDVAVYYCQHSRELPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSISSYGVHWIRQPPGKGLEWIGVIWTSGVTDYNSALMGRVTISVDTSKNQFSLKLSSVTAADTAVYYCARDGDYDRYTMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9957 - protein, 606 aa, Artificial Sequence
  Synthetic Polypeptide
MTALFLMSMLFGLACGQAMSFCIPTEYTMHIERRECAYCLTINTTICAGYCMTRDINGKLFLPKYALSQDVCTYRDFIYRTVEIPGCPLHVAPYFSYPVALSCKCGKCNTDYSDCIHEAIKTNYCTKPQKSYLVGFSVLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEAPDVQDCPECTLQENPFFSQPGAPILQCMGCCFSRAYPTPLRSKKTMLVQKNVTSESTCCVAKSYNRVTVMGGFKVENHTACHCSTCYYHKSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9958 - protein, 623 aa, Artificial Sequence
  Synthetic Polypeptide
MALPVTALLLPLALLLHAARPQSVLTQPPSVSVSPGQTASITCSGDKLGDKYACWYQQKPGQSPVLVIYQDSKRPSGIPERFSGSNSGNTATLTISGTQAMDEADYYCQAWDSSTAVVFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGQSLKISCKASGYSLTDNWIGWVRQKPGKGLEWMGIIYPGDSDTRYSPSFQGQVTISADKSINTAYLQWSSLKASDTAIYYCVGLDWNYNPLRYWGPGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9959 - protein, 621 aa, Artificial Sequence
  Synthetic Polypeptide
MALPVTALLLPLALLLHAARPDIVMTQSQKFMSTSVGDRVSIICKASQNVGTFVAWYQQKPGQSPKLLVYSASNRYTGVPDRFTGSGSGTDFTLTINNMQSEDLADYFCRQYSSYPYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPELVKPGASMKISCKASGYSFSAYTMNWVKQSHGKNLEWIGLINPYNGGTNYNQEFEGKATLTVNKSSNTAFMELLSLTSDDSAVYYCARRDWDYFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9960 - protein, 632 aa, Artificial Sequence
  Synthetic Polypeptide
MALPVTALLLPLALLLHAARPAIQMTQSPSSLSASVGDRVTITCRASQSISNYLNWYQQKPGKAPKLLIYAASSLQSGVPSRFSGSGSGTDFTLTISSLQPEDFATYYCQQSYSSPSTTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLIQPGGSLRLSCAASGFTVSSNYMSWVRQAPGKGLEWVSVTYSGGSTSYADSVKGRFTISRDNSKNTLYLQMNSLRAEDTAVYYCARGGRYCSSISCYARSGCDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9961 - protein, 627 aa, Artificial Sequence
  Synthetic Polypeptide
MALPVTALLLPLALLLHAARPDIQMTQSPSSLSASVGDRVTITCRASQSIGTSLHWYQQKPGKAPKLLIKFASRLQSGVPSRFSGSGSGTDFTLTISSLQPEDFATYYCQQSPGFPPTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGLVKPGGSLRLSCAASGFSITTSGYYWTWIRQFPGKGLEWMGYIGYNSKTYYNPALKSRITISRDNAKNSLYLQMNSLRAEDTAVYYCARSLYGGYKDAFDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9962 - protein, 628 aa, Artificial Sequence
  Synthetic Polypeptide
MALPVTALLLPLALLLHAARPDEIVLTQSPGTLSLSLGERATLSCRASQSISSSFLAWYQQKPGQAPKLLIYAASTRATGIPDRFSGSGSGTDFTLTISRLEPEDFAVYYCQQYGRSLSFGGGTKVEVKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGPGLVKPSQTLSLTCAISGDSVSGNSATWNWIRQSPSRGLEWLGRTYYRSKWNHDYAESVKSRITINPDTSKNQFSLQLNSVTPEDTAVYYCARGDSSSWYAFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9963 - protein, 627 aa, Artificial Sequence
  Synthetic Polypeptide
MALPVTALLLPLALLLHAARPDQSVVTQPPSVSVAPGKTARITCGRNNIGSKSVHWYQQKPGQAPVLVVYDDSDRPSGIPERFSGSNSGNTATLTISRVEAGDEADYYCQVWDSSSDHVVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVQSGGGVMRPGGSLRLSCAASGFTFDDYGMSWVRQAPGKGLEWVSGINWNGGSTGYADSVRGRFTISRDNAKNSLYLQMNSLRAEDTALYYCARERGYGYHDPHDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9964 - protein, 640 aa, Artificial Sequence
  Synthetic Polypeptide
MALPVTALLLPLALLLHAARPEQKLISEEDLEFQAVVTQPPSASGTPGQRVTISCSGSSSNIGSNTVNWYQQVPGTAPKLLIYSNNQRPSGVPDRFSGSKSGTSASLAISGLQSEDEADYYCAAWDDSLNGWVFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQMQLVQSGAEVKEPGESLRISCKGSGYSFTNFWISWVRQMPGKGLEWMGRVDPGYSYSTYSPSFQGHVTISADKSTSTAYLQWNSLKASDTAMYYCARVQYSGYYDWFDPWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9965 - protein, 634 aa, Artificial Sequence
  Synthetic Polypeptide
MALPVTALLLPLALLLHAARPEQKLISEEDLEFDIQMTQSPSTLSASVGDRVTITCRASQNINKWLAWYQQRPGKAPQLLIYKASSLESGVPSRFSGSGSGTEYTLTISSLQPDDFATYYCQQYNSYATFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGESLKISCKGSGYNFSNKWIGWVRQLPGRGLEWIAIIYPGYSDITYSPSFQGRVTISADTSINTAYLHWHSLKASDTAMYYCVRHTALAGFDYWGLGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9966 - protein, 626 aa, Artificial Sequence
  Synthetic Polypeptide
MALPVTALLLPLALLLHAARPDIVLTQSPASLAVSLGQRATISCRASESVDNYGNTFMHWYQQKPGQPPKLLIYRASNLESGIPARFSGSGSRTDFTLTINPVEADDVATYYCQQSNEDPPTFGAGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGPELKKPGETVKISCKASGYIFTNYGMNWVKQAPGKSFKWMGWINTYTGESTYSADFKGRFAFSLETSASTAYLHINDLKNEDTATYFCARSGGYDPMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9967 - protein, 625 aa, Artificial Sequence
  Synthetic Polypeptide
MALPVTALLLPLALLLHAARPDEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9968 - protein, 626 aa, Artificial Sequence
  Synthetic Polypeptide
MALPVTALLLPLALLLHAARPDDIVLTQTPATLSVTPGDSVSLSCRASQSISNNLHWYQQKSHESPRLLIKNASQSISGIPSKFSGSGSGTDFTLRINSVETEDFGMYFCQQSNSWPYTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVKLQQSGPELVKPGASVKISCKASGYSFTGYYMHWVKQSHGNILDWIGYIYPYNGVSSYNQKFKGKATLTVDKSSSTAYMELRSLTSEDSAVYYCARERGLYQLRAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9969 - protein, 617 aa, Artificial Sequence
  Synthetic Polypeptide
MALPVTALLLPLALLLHAARPDDIVMTQTPAIMSASPGQKVTITCSASSSVNYMHWYQQKLGSSPKLWIYDTSKLAPGVPARFSGSGSGTSYSLTISSMEAEDAASYFCHQWSSYPYTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQESGPDLVKPSQSLSLTCTVTGYSITSGYGWHWIRQFPGNKLEWMGYIHYSGSTTYNPSLKSRISISRDTSKNQFFLQLNSVTTEDTATYYCARSLRYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9970 - protein, 620 aa, Artificial Sequence
  Synthetic Polypeptide
MALPVTALLLPLALLLHAARPDDIQMTQSPSSLSASVGDRVTITCSATSSISYMHWYQQKPGKAPKGWIYDTSKLAHGVPSRFSGSGSGTDFTLTISSLQPEDFATYYCHQRRSYPFTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTNFWIHWVRQAPGQGLEWIGEIDPSDSYTNYNQKFKGRVTITRDTSTSTAYLELSSLRSEDTAVYYCAREITTVDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9971 - protein, 627 aa, Artificial Sequence
  Synthetic Polypeptide
MALPVTALLLPLALLLHAARPDDIQMTQSPSSLSASVGDRVTITCKASQGFNKYVAWYQQKPGKAPKLLIYYTSTLQPGVPSRFSGSGSGRDYTLTISSLQPEDFATYYCLQYGNLLYAFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTSYWIGWVRQAPGQGLEWIGDIYPGGGYTNYNEKFKGRVTITRDTSTSTAYLELSSLRSEDTAVYYCARLDGSSYRGAMDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9972 - protein, 623 aa, Artificial Sequence
  Synthetic Polypeptide
MALPVTALLLPLALLLHAARPDDIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLAKPGGSLRLSCAASGFRFTFNNYYMDWVRQAPGQGLEWVSRISSSGDPTWYADSVKGRFTISRENAKNTLFLQMNSLRAEDTAVYYCASLTTGSDSWGQGVLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9973 - protein, 623 aa, Artificial Sequence
  Synthetic Polypeptide
MALPVTALLLPLALLLHAARPEIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9974 - protein, 624 aa, Artificial Sequence
  Synthetic Polypeptide
MALPVTALLLPLALLLHAARPEIVMTPSSATLSVSPGERATLSCRASQSVSRNLAWYQQKPGQAPRLLIYGASTRATGIPARFSGSGSGTEFTLTISSLQSEDFAVYYCHQYSNWMCSFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSRYAMNWVRQAPGKGLEWVSGISGSGGRTYYADSVKGRFTISRDNSKNTLYLQMNSLRAEDTAVYYCAKDRDFWSGPFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9975 - protein, 629 aa, Artificial Sequence
  Synthetic Polypeptide
MALPVTALLLPLALLLHAARPDIQMTQSPSSLSASVGDRVTITCKASKNIRSYLAWYQQKPGKAPKLLIYSGSTLHSGVPSRFSGSGSGTDFTLTISSLQPEDFATYYCQQHHEYPLTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGYTITSGYDWSWIRQPPGKGLEWIGYINYGGSTNYKPSLGSRVTISVDTSKNQFSLKLSSVTAADTAVYYCARYNEYKSYIYDWYFDFWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9976 - protein, 625 aa, Artificial Sequence
  Synthetic Polypeptide
MALPVTALLLPLALLLHAARPQSVLTQPASVSGSPGQSITISCTGTSSDVGGYNYVSWYQQHPGKAPKLMIYDVNNRPSEVSNRFSGSKSGNTASLTISGLQAEDEADYYCSSYTTGSRAVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGESLTISCKASGYSFPNYWITWVRQMSGGGLEWMGRIDPGDSYTTYNPSFQGHVTISIDKSTNTAYLHWNSLKASDTAMYYCARYYVSLVDIWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9977 - protein, 631 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSGSKSGTSATLGITGLQTGDEADYYCGTWDGSLYTMLFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSNAWMSWVRQAPGKGLEWVGFIRSKAYGGTTEYAASVKGRFTISRDDSKSIAYLQMNNLKTEDTAVYYCARDGLYSSSWYDSDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9978 - protein, 636 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIFGNSNRPSGVPDRFSGFKSGTSASLAITGLQAEDEADYFCQSYDSSLSGSGVFGTGTKVTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQMQLVQSGGGLVQPGRSLRLSCAASGFTFDDYAMHWVRQAPGKGLEWVSGISWNSGSIGYADSVKGRFTISRDNAKNSLYLQMNSLRAEDTALYYCAKDIHSGSYYGLLYYAMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9979 - protein, 636 aa, Artificial Sequence
  Synthetic Polypeptide
MALPVTALLLPLALLLHAARPLPVLTQPPSASGTPGQRVTISCSGRSSNIGSNSVNWYRQLPGAAPKLLIYSNNQRPPGVPVRFSGSKSGTSASLAISGLQSEDEATYYCATWDDNLNVHYVFGTGTKVTVLGSRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFELEMAQVQLVQSGAEVKKPGSSVKVSCKASGGTFSSYAISWVRQAPGQGLEWMGRIIPILGIANYAQKFQGRVTITADKSTSTAYMELSSLRSEDTAVYYCARGGYYSHDMWSEDWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9980 - protein, 626 aa, Artificial Sequence; identical to SEQ ID NO: 9845
  Synthetic Polypeptide

SEQ ID NO: 9981 - protein, 626 aa, Artificial Sequence
  Synthetic Polypeptide
MALPVTALLLPLALLLHAARPDIVLTQSPATLSLSPGDRATLSCRASESVTILGSHLIYWYQQKPGQAPRLLIQLASNVQTGIPARFSGSGSRTDFTLTISSLEPEDFAVYYCLQSRTIPRTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGSELKKPGESVKISCKASGYTFTHYSMNWVRQAPGQGLEWMGRINTETGEPLYADDFKGRFVFSLDTSASTAYLQISSLKAEDTAVYYCSNDYLYSLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9982 - protein, 630 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9983 - protein, 630 aa, Artificial Sequence
  Synthetic Polypeptide
MALPVTALLLPLALLLHAARPDFVMTQSPDSLAVSLGERVTMSCKSSQSLLNSGNQKNYLTWYQQKPGQPPKLLIYWASTRESGVPDRFSGSGSGTDFTLTISSLQAEDVAVYYCQNDYSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAELKKPGASVKVSCKASGYTFTDYYMKWVRQAPGQGLEWIGDIIPSNGATFYNQKFKGRVTITVDKSTSTAYMELSSLRSEDTAVYYCARSHLLRASWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9984 - protein, 624 aa, Artificial Sequence
  Synthetic Polypeptide
MALPVTALLLPLALLLHAARPEIVLTQSPGTLSLSPGERATLSCRASQSVSSSYLAWYQQKPGQAPRLLIYGASSRATGIPDRFSGSGSGTDFTLTISRLEPEDFAVYYCQQDYGFPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWISWVRQMPGKGLEWMGIIDPSDSDTRYSPSFQGQVTISADKSISTAYLQWSSLKASDTAMYYCARGDGSTDLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9985 - protein, 626 aa, Artificial Sequence
  Synthetic Polypeptide
MALPVTALLLPLALLLHAARPQFVLTQPPSVSTNPGSTVKLSCKRNTGNIGSNYVNWYQQKPGQSPTTMIYRDDKRPDGVPDRFSGSIDRSSNSALLTINNVQTEDEADYFCQSYSSGINIIFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGFSLTTYDVHWVRQPPGKGLEWMGRIQNAGITDYNSALKSRLIISRDTSKSQVFLKMNSVTTADTAMYFCAKTGSYFYAFDHWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9986 - protein, 623 aa, Artificial Sequence
  Synthetic Polypeptide
MALPVTALLLPLALLLHAARPDIQMTQSPASLSASLGETVTIECRPSEDIHSNVAWYQQKPGNSPQLLIYDASNLADGVPSRFSGSGSGTQYSLKINSLQSEDVASYFCHQYNIYPYTFGSGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPTLVKPGDSVKMSCKASGYTFTDYIIHWVKQSHGKSLEWIGYINPYSDGTNYNEKFKSKATLTVDKSTSTAYMEFSRLTSEDSAIYFCALNYGSYYAMDAWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9987 - protein, 624 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSGYWMHWVRQAPGKGLEWVSAIRSDGSSKYYADSVKGRFTISRDNSKNTLYLQMNSLRAEDTAVYYCAKDGVIEDTFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9988 - protein, 620 aa, Artificial Sequence
  Synthetic Polypeptide
MALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9989 - protein, 623 aa, Artificial Sequence
  Synthetic Polypeptide
MALPVTALLLPLALLLHAARPDIQMTQSPASLSASLGETVTIECRTSKDIYSNLAWFQQEPGNSPQLLIYDASNLADGVPSRFSGSGSGTQYSLQINNLQSEDVASYFCHQYNNYPYTFGTGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPTLVNPGDSVKMSCKASGYTFTDHIIHWVKQSHGKSLEWIGYINPYSGGANYNGKFKSKATLTIDKSSSTAYMEFSRLTSGDSAIYYCALNYGSYYAMDAWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9990 - protein, 622 aa, Artificial Sequence
  Synthetic Polypeptide
MALPVTALLLPLALLLHAARPEIVLTQSPTSMTASPGEQVTITCRASSSINYMHWYQQKPGASPRPWIYETSKLASGVPDRFSGSASGTSYSLTINNMEAEDAATYYCQQWNYPSWTFGGGTKLELKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGRSLKLSCAASGFTFSDYNMAWVRQAPKKGLEWVATILYDGGRTYYRGSVKGRFTISRDNAKSTLYLRMDSLRSEDTATYYCATHSRGTDYFDYWGQGVMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9991 - protein, 631 aa, Artificial Sequence
  Synthetic Polypeptide
MALPVTALLLPLALLLHAARPDIVMTQSPSSLAVSEGETVTINCKSSQSFLSSGDGKNYVAWYQYKPGQSPKLLIYWASTRQSGVPDRFIGSGSGTDFTLTISTVQAEDLAIYYCQQYYDTPLTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVKLQESGPSLVQSSQTLSLTCTVSGFSLTSYHIHWVRQTPGKGLEWMGVMWSDGDTSYNSALKSRLSISRDTSQSQVFLKMNSLQTEDTATYYCARGYYSSYLYLWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9992 - protein, 635 aa, Artificial Sequence
  Synthetic Polypeptide
MALPVTALLLPLALLLHAARPDVLMTQTPVSLPVSLGGQVSISCRSSQSLVHSDGDTYLHWYLQKPGQSPQLLIYRVSNRFSGVPDRFSGSGSGTDFTLKISRVEPEDLGLYYCLQTTHFPPWTFGGGTKLEMKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGPELRRPGSSVRLSCKASGYRIKDFLIHWIKNRPEHGLEWIGWIDPEDGETKYAQKFQTKATLTADTSSNTAYMQLSSLTSEDTATYFCARWGDVYYGLMRGHVMDAWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9993 - protein, 630 aa, Artificial Sequence
  Synthetic Polypeptide
MALPVTALLLPLALLLHAARPDIVMTQSPATLSLSPGERATLSCRSSKSLQNVNGNTYLYWFQQKPGQSPQLLIYRMSNLNSGVPDRFSGSGSGTEFTLTISSLEPEDFAVYYCMQHLEYPITFGAGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLKLSCAASGYTFTSYVMHWVRQAPGKGLEWIGYINPYNDGTKYNEKFQGRVTISSDKSISTAYMELSSLRSEDTAMYYCARGTYYYGTRVFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9994 - protein, 626 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9995 - protein, 626 aa, Artificial Sequence
  Synthetic Polypeptide
MALPVTALLLPLALLLHAARPDIVLTQSPAIITASPGEKVTMTCRASSSVNYMDWYQKKPGSSPKPWIYATSNLASGVPSRFSGSGSGTTYSMTISSLEAEDAATYYCQQWSFNPPTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGAELKKPGASVKVSCKASGYTFTSYNMHWVKQTPGQGLEWIGAIYPGNGDTSYNQKFKGKTTLTADKSSSTAYMELSSLRSEDTAVYYCARSNYYGSSYWFFDVWGTGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9996 - protein, 629 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSDWPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGGGLVHPGGSLRLSCTGSGFTFSYHAMHWVRQAPGKGLEWVSIIGTGGVTYYADSVKGRFTISRDNVKNSLYLQMNSLRAEDMAVYYCARDYYGAGSFYDGLYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9997 - protein, 627 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEAVQLVESGGGLVQPGRSLRLSCAASGFTFGDYTMHWVRQAPGKGLEWVSGISWNSGSIGYADSVKGRFTISRDNAKNSLYLQMNSLRAEDTALYYCTKDNQYGSGSTYGLGVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9998 - protein, 626 aa, Artificial Sequence
  Synthetic Polypeptide
MALPVTALLLPLALLLHAARPDIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 9999 - protein, 628 aa, Artificial Sequence
  Synthetic Polypeptide
MALPVTALLLPLALLLHAARPQIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10000 - protein, 625 aa, Artificial Sequence
  Synthetic Polypeptide
MALPVTALLLPLALLLHAARPEIVLTQSPSSLSASVGDRVTITCRASSSLSFMHWYQQKPGKAPKPWIYATSNLASGVPSRFSGSGSGTDYTLTISSLQPEDFATYFCHQWSSNPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTSYNMHWVRQAPGQRLEWIGAIYPGNGDTSYNQKFKGRVTVTRDTSANTAYMELSSLKSEDTAVYYCARSHYGSNYVDYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10001 - protein, 626 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10002 - protein, 627 aa, Artificial Sequence
  Synthetic Polypeptide
MALPVTALLLPLALLLHAARPDIQLTQSPSSLSASVGDRVTITCRASQGISSVLAWYQQKPGKAPKLLIYDASSLESGVPSRFSGSGSGTDFTLTISSLQPEDFATYYCQQFNSSITFGQGTKLEIKRTVAALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSDYAISWVRQAPGQGLEWMGRIIPILGVANYAQKFQGRVTITADKSTRTAYMELSSLRSEDTAVYYCARNWADAFDIWGQGTMVTVSSASTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10003 - protein, 626 aa, Artificial Sequence
  Synthetic Polypeptide
MALPVTALLLPLALLLHAARPDIVMTQSPSSLSASLGGKVTITCKASQDINKYIAWYQHKPGKGPRLLIHYTSTLQPGIPSRFSGSGSGRDYSFSISNLEPEDIATYYCLQYDNLLTFGAGTKLELKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVKLQQSGPELVKPGTSVKVSCKASGYSFTDYNMYWVKQSHGKSLEWIGYIDPYKGGTIYNQKFKGKATLTVDKSSSTAFMHLNSLTSEDSAVYYCAREMITAYYFDYWGQGSSVTVSSLERTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10004 - protein, 621 aa, Artificial Sequence
  Synthetic Polypeptide
MALPVTALLLPLALLLHAARPDIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10005 - protein, 626 aa, Artificial Sequence
  Synthetic Polypeptide
MALPVTALLLPLALLLHAARPEIVLTQSPLSLPVTPGEPASISCRSSQSLLHSNGYNYLDWYLQKPGQSPQLLIYLGVNSVSGVPDRFSGSGSGTDFTLKISRVEAEDVGVYYCMQALQTPWTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGIFSNHAISWVRQAPGQGLEWMGGIIPIFGTANYAQKFQGRVTITADESTSTAFMELSSLRSEDTAVYYCAREWADVFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10006 - protein, 625 aa, Artificial Sequence
  Synthetic Polypeptide
MALPVTALLLPLALLLHAARPDIQMTQSPASLTVSLGQRATISCRASESVDSYGNSYLHWYQQKPGQPPQLLIYLASNLESGVPARFSGSGSRTDFTLTIDPVEADDAATYYCQQNNEDPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGAELVKPGASVKMSCKAFGYTFTTFPIEWMKQSHGKSLEWIGNFHPYNDQTKYNEEFKGRAKLTIDRSSSTVYLELGRLTSDDSAVYYCARGYYYAFDFWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10007 - protein, 625 aa, Artificial Sequence; identical to SEQ ID NO: 10006
  Synthetic Polypeptide

SEQ ID NO: 10008 - protein, 622 aa, Artificial Sequence
  Synthetic Polypeptide
MALPVTALLLPLALLLHAARPDIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGALIQPGGSLRLSCVASGFTISGNYMSWVRQAPGKGLEWVSLIYSGDSTYYADSVKGRFTISRDISKNTVYLQMNSLRVEDTAVYYCVRDGYYVSDMVVWGKGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10009 - protein, 623 aa, Artificial Sequence
  Synthetic Polypeptide
MALPVTALLLPLALLLHAARPDIVMTQTPLSLSVTPGQPASISCKSSQSLLDGDGKTYLNWLLQKPGQSPQRLIYLVSKLDSGVPDRFSGSGSGTDFTLKISRVEAEDVGVYYCWQGTHFPRTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFKDTYIHWVRQAPGQGLEWMGRIDPANGNTKYDPKFQGRVTMTRDTSISTAYMELSRLRSDDTAVYYCARRGGVDWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10010 - protein, 624 aa, Artificial Sequence
  Synthetic Polypeptide
MALPVTALLLPLALLLHAARPDIQMTQSPSSLSASVGDRVTITCKASQDVSTAVAWFQQKPGKAPKLLIYSPSYRYTGVPSRFSGSGSGTDFTLTISSLQPEDFTYYCQQLYSTPYTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTDYYLDVVVRQAPGQGLEWIGRVNPYNGGTIYNQKFKGRVTLTRDTSTSTAYLELSSLRSEDTAVYYCARDHYRYDPLLDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10011 - protein, 630 aa, Artificial Sequence
  Synthetic Polypeptide
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10012 - protein, 628 aa, Artificial Sequence
  Synthetic Polypeptide
MALPVTALLLPLALLLHAARPEIVLTQSPATLSASPGERVTLTCRASSNVISSYVHWYQQKPGSSPRLFLYSTSNLASGVPSRFSGSGSGTDFTFTISSLEAEDAATYYCQQYSGYPLTFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCAVSGYSITSAYYWNWIRQPPGKGLEWIGYISYDGRNNYNPSLKNRITINPDTSKNQFSLQLNSVTPEDTAVYYCAREGDYDVGNYYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10013 - protein, 628 aa, Artificial Sequence
  Synthetic Polypeptide
MALPVTALLLPLALLLHAARPEIVLTQSPATLSLSPGERATLSCRASSNVISSYVHWYQQKPGQAPRLLIYSTSNLASGIPARFSGSGSGTDFTLTISSLEPEDFAVYYCQQYSGYPLTFGQGTRLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGRSLRLSCAASGYSITSAYYWNWVRQAPGKGLEWVSYISYDGRNNYNPSLKNRFTISRDNAKKSLYLQMNSLRAEDTALYYCAKEGDYDVGNYYAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10014 - protein, 626 aa, Artificial Sequence
  Synthetic Polypeptide
MALPVTALLLPLALLLHAARPDIQMTQSPSSLSASVGDRVTITCKASQDVSTAVAWYQQKPGKAPKLLIYSASYRYTGVPDRFTGSGSGTDFTLTISSLQPEDFATYYCQQHYSTPPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYAFSSSWMNWVRQAPGQGLEWIGRIYPGDGDTKYNGKFKGKATLTADKSTSTAYMELSSLRSEDTAVYYCARSTMIATGAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10015 - protein, 627 aa, Artificial Sequence
  Synthetic Polypeptide
MALPVTALLLPLALLLHAARPDVVMTQTPLSLSVTPGQPASISCRSSQSLVHNNGNTYLHWYLQKPGQSPQLLIYKVSNRFSGVPDRFSGSGSGTDFTLKISRVEAEDVGVYFCSQSTHVPPYTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVAEINYDGSSTYYVDSVKGRFTISRDNAKNSLYLQMNSLRAEDTAVYYCARDRGFYFDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10016 - protein, 627 aa, Artificial Sequence
  Synthetic Polypeptide
MALPVTALLLPLALLLHAARPDVVMTQTPLSLSVTPGQPASISCRSSQSLVHSNGLTYLHWYLQKPGQSPQLLIYKVSNRFSGVPDRFSGSGSGTDFTLKISRVEAEDVGVYFCSQSTHVPPFTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVASINYDGESTYYVDSVKGRFTISRDNAKNSLYLQMNSLRAEDTAVYYCARDRGYYFDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10017 - protein, 627 aa, Artificial Sequence
  Synthetic Polypeptide
MALPVTALLLPLALLLHAARPDVVMTQSPLSLPVTPGEPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYYMAWVRQAPGKGLEWVADINYDGGSTYYLDSLKSRFTISRDNAKNSLYLQMNSLRAEDTAVYYCARDRGYYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10018 - protein, 625 aa, Artificial Sequence
  Synthetic Polypeptide
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10019 - protein, 625 aa, Artificial Sequence
  Synthetic Polypeptide
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPPYTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGPELVKPGASVKISCKASGYAFSSSWMNWVKQRPGQGLEWIGRIYPGDGDTKYNGKFKGKATLTADKSSSTAYMQLSSLTSVDSAVYFCARSTMIATGAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10020 - protein, 627 aa, Artificial Sequence
  Synthetic Polypeptide
MALPVTALLLPLALLLHAARPDVVMTQTPLSLPVSLGDQASISCRSSQSLVHSNGNTYLRWYLQKPGQSPKVLIYKVSNRVSGVPDRFSGSGSGTDFTLKINRVEAEDLGVYFCSQSTHVPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEGVKLDETGGGLVQPGGAMKLSCVTSGFTFGHYWMNWVRQSPEKGLEWVAQFRNKPYNYETYYSDSVKGRFTISRDDSKSSVYLQMNNLRVEDTGIYYCTGASYGMEYLGQGTSVTVSTTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10021 - protein, 633 aa, Artificial Sequence
  Synthetic Polypeptide
MALPVTALLLPLALLLHAARPQVQLVESGGNLVQPGGSLRLSCAASGFTFGSFSMSWVRQAPGGGLEWVAGLSARSSLTHYADSVKGRFTISRDNAKNSVYLQMNSLRVEDTAVYYCARRSYDSSGYWGHFYSYMDVWGQGTLVTVSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFESVLTQPSSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLGTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10022 - protein, 624 aa, Artificial Sequence
  Synthetic Polypeptide
MALPVTALLLPLALLLHAARPQSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSYVFGTGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVETGGNLVQPGASLRLSCAASGFSFSGTAMHWVRQAPGKGLEWVSTISSTGRSTYYRDSVKGRFTISRDNSKNTLYLQMNSLRGEDTAVYYCARVSFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10023 - protein, 626 aa, Artificial Sequence
  Synthetic Polypeptide
MALPVTALLLPLALLLHAARPQSVVTQPASVSGSPGQSITISCTGTSSDVGGYNYVSWYQQHPGKAPKLMIYDVSKRPSGVSNRFSGSKSGNTASLTISGLQAEDEADYYCSSYTSSSTLVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGAFVQPGGSLRLSCAASGFTFSSYAMTWVRQAPGKGLEWVSTISGRGRSTFYADSVKGRFTISRDNSKNTLYLQMNSLRAEDTAVYYCARYYHAGAFDLWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10024 - protein, 628 aa, Artificial Sequence
  Synthetic Polypeptide
MALPVTALLLPLALLLHAARPDVVMTQSPSSLSASVGDRVTITCQSSLDISHYLNWYQQKPGKAPKLLIYDASNLETGVPSRFSGSGSGTHFTFTISSLQPEDFATYYCQQYDNLPLTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGGGVVQPGGSLRVSCAASGVTLSDYGMHWVRQAPGKGLEWVAFIRNDGSDKYYADSVKGRFTISRDNSEKTVSLQMSSLRAEDTAVYYCAKNGESGPLDYWYLDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10025 - protein, 632 aa, Artificial Sequence
  Synthetic Polypeptide
MALPVTALLLPLALLLHAARPSYELTQPPSVSGTPGQRVAISCSGSSSNIGTRMVTWYQHVPGTAPKLLIFNNNQRPSGVPDRFSASKSGTSASLAIIGLQSDDEADYYCATWDDNVKSYVFGTGTKVTVLGSRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFELEMAQVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARAPQSWYVGDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10026 - protein, 629 aa, Artificial Sequence
  Synthetic Polypeptide
MALPVTALLLPLALLLHAARPQSVLTQPPSLSVAPGKTASITCGGNNIGMKSVHWYQQRPGQAPVLVIYYDSDRPSGIPGRFSGSNSGNTATLTISRVEAGDEADYYCQVWDTTGDHPGYVFGTGTKVTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGVYGYSGSAPYDEWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10027 - protein, 622 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVRKPGSSVKVSCKASGGSFNNYPIFWVRQAPGQGFEWMGRIIPILGITAYAQKFQGRVTITADKSTSTAYMELNSLRSEDTAVYYCAGGDDLDAFDIWGQGTMVSVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10028 - protein, 626 aa, Artificial Sequence
  Synthetic Polypeptide
MALPVTALLLPLALLLHAARPQVQLQQSDAELVKPGSSVKISCKASGYTFTDHAIHWVKQKPEQGLEWIGHFSPGNTDIKYNDKFKGKATLTVDRSSSTAYMQLNSLTSEDSAVYFCKTSTFFFDYWGQGTTLTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEELVMTQSPSSLTVTAGEKVTMICKSSQSLLNSGDQKNYLTWYQQKPGQPPKLLIFWASTRESGVPDRFTGSGSGTDFTLTISSVQAEDLAVYYCQNDYSYPLTFGAGTKLELKTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10029 - protein, 627 aa, Artificial Sequence
  Synthetic Polypeptide
MALPVTALLLPLALLLHAARPEVQLVESGGGLVQPGRSLRLSCAASGFTFDDYAMHWVRQAPGKGLEWVSGISWNSGSIGYADSVKGRFTISRDNAKNSLYLQMNSLRAEDTALYYCAKDKGGGYYDFWSGSDYWGQGTLVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFESSELTQDPAVSVALGQTVRITCQGDSLRSYYASWYQQKPGQAPVLVIYGKNNRPSGIPDRFSGSSSGNTASLTITGAQAEDEADYYCNSRDSSGWVFGGGTKLTVLTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10030 - protein, 636 aa, Artificial Sequence
  Synthetic Polypeptide
MALPVTALLLPLALLLHAARPEVQLQQSGPGLVKPSQTLSLTCAISGDSVLSNSDTWNWIRQSPSRGLEWLGRTYHRSTWYDDYASSVRGRVSINVDTSKNQYSLQLNAVTPEDTGVYYCARDRLQDGNSWSDAFDVWGQGTMVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTLVYVFGTGTKVTVLTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10031 - protein, 614 aa, Artificial Sequence
  Synthetic Polypeptide
MALPVTALLLPLALLLHAARPQVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARGDSTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQSVLTQPRSVSGSPGQSVTISCTGTSSDVGGYNYVSWYQQHPGEAPKLIIYDADKRPSGISNRFSSGKSGNTASLTISGLQVEDEADYYCCSYAGGSTWVFGGGTKVTVLTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10032 - protein, 636 aa, Artificial Sequence
  Synthetic Polypeptide
MALPVTALLLPLALLLHAARPEVQLQQSGPGLVKPSQTLSLTCAISGDSVSSNSAAWNWIRQSPSRGLEWLGRTYYRSKWYSDYAVSVKSRITINPDTSKNQFSLQLNSVTPEDTAVYYCARDPYDFWSGYPDAFDIWGQGTMVTVSSLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQSALTQPASVSGSPGQSITISCTGTSSDVGGYNYVSWYQQHPGKAPKVIISEVNNRPSGVSHRFSGSKSGNTASLTISGLQAEDEADYFCSSYTSGRTLYVFGTGSKVTVLGTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10033 - protein, 635 aa, Artificial Sequence
  Synthetic Polypeptide
MALPVTALLLPLALLLHAARPQSALTQPASASGSPGQSVTISCTGTSSDVGGYNYVSWYQQHPGKAPKLMIYDVSNRPSGVSNRFSGSKSGNTASLTISGLQAEDEADYYCSSYTSSSTLYVFGTGTQLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLQQSGPGLVKPSQTLSLTCAISGDSMLSNSDTWNWIRQSPSRGLEWLGRTYHRSTWYDDYASSVRGRVSINVDTSKNQYSLQLNAVTPEDTGVYYCARVRLQDGNSWSDAFDVWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10034 - protein, 635 aa, Artificial Sequence
  Synthetic Polypeptide
MALPVTALLLPLALLLHAARPDVMLTQTPLSLPVSLGDQASISCRSSQSILHSTGDTYLEWYLQKPGQSPKLLINKVSNRLSGVPDRFSGSGSGTDFTLKISRVEAEDLGVYYCFQGSHVPWTFGGGTKLEIKRADAAPTVSIFPLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVKLQQSGPSLVKPGASVKMSCKASGYTFTDFYMKWVKQSHGKSLEWIGDINPNIGDTFYNQKFKGKATLTVDKSSSTAYMQLNSLTSEDSAVYFCSVGYFDVWGAGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10035 - protein, 631 aa, Artificial Sequence
  Synthetic Polypeptide
MALPVTALLLPLALLLHAARPEIVLTQSPATLSLSPGERATLSCRASQSVSIYLAWYQQKPGQAPRLLIYDASNRATGIPARFSGSGSGTDFTLTISSLEPEDFAVYYCQQRSNWPPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVIWDDGSNKYYVDSVKGRFTISRDNSKNTLYLQMNSLRAEDTAVYYCARDDYYGSGSFNSYYGTDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10036 - protein, 616 aa, Artificial Sequence
  Synthetic Polypeptide
MALPVTALLLPLALLLHAARPDIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGGGLVHPGGSLRLSCAGSGFTFSTYLMYWVRQAPGKTLEWVSAIGSGGDTYYADSVKGRFTISRDNAKNSLYLQMNSLRAEDMAVYYCARGLGYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10037 - protein, 635 aa, Artificial Sequence
  Synthetic Polypeptide
MALPVTALLLPLALLLHAARPLPVLTQPPSVSVAPGKTARITCGGNNIGSKSVHWYQQKPGQAPVLVVYDDSDRPSGIPERFSGSNSGNTATLTISRVEAGDEADYYCQVWDSSSDYVVFGGGTKLTVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQVWGWQGGMYPRSNWWYNLDSWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10038 - protein, 625 aa, Artificial Sequence
  Synthetic Polypeptide
MALPVTALLLPLALLLHAARPQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGTGTKVLVLLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYTINVWRQAPGQGLEWMGGFIPISGTVNYAQKFQGRVTITADESTSTAYMELSSLRSEDTAVYYCARPLDWTEDIWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10039 - protein, 628 aa, Artificial Sequence
  Synthetic Polypeptide
MALPVTALLLPLALLLHAARPNFMLTQPHSVSESPGKTVTISCTGSSGSIASNYVQWYQQRPGSAPTILIYEDNKRPSGVPDRFSGSIDSSSNSASLTISGLKTGDEADYYCQSYDDINHWVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVQSGAEVKKPGASVKVSCKASGYTFTAYYLHWLRQAPGQGLEWMGWMNTNNGATRYAQKFQDRVTMTRDTSINTAYMEMSGLSSDDTAMYYCARGDISQDFADVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10040 - protein, 620 aa, Artificial Sequence
  Synthetic Polypeptide
MALPVTALLLPLALLLHAARPQIVLTQSPAIMSASPGEKVTITCSASSSVSYMHWFQQKPGTSPKLWIYSTSNLASGVPARFSGSGSGTSYSLTISRMEAEDAATYYCQQRSSYPPTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYDYPWFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10041 - protein, 628 aa, Artificial Sequence
  Synthetic Polypeptide
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10042 - protein, 626 aa, Artificial Sequence
  Synthetic Polypeptide
MALPVTALLLPLALLLHAARPDTQMTQSPSSVSASVGDRVTITCRTSQDISNYLNWYQQKPGKAPKLLIYNTSRLHSGVPSRFSGSGSGTDFTLTISSLQPEDFATYYCQQSNMFPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFNGYFMNWVRQAPGQGLERMGRINPNNGDSFYNQKFQGRVTMTRDTSTSTVYMELPSLRSEDTAVYYCAREGYYGGRGYALDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10043 - protein, 625 aa, Artificial Sequence
  Synthetic Polypeptide
MALPVTALLLPLALLLHAARPQSVVTQPPSVSAAPGQKVTISCSGSSSNIGNNYVSWYQQLPGTAPKLLIYDNNKRPSGIPDRFSASKSGTSATLGITGLQTRDEADYYCGTWDSSLSAWVFGGGTKLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGDTFSSYYISWVRQAPGQGLEWMGRIIPILGIANYAQKYQGRVTLSADKSTSTSYMELNSLSSEDTAVYYCALDWSYSIDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10044 - protein, 628 aa, Artificial Sequence
  Synthetic Polypeptide
MALPVTALLLPLALLLHAARPELVMTQSPASLAVSLGQRATISCRASESVDSYGKSFMHWYQLKPGQPPKLLIYRASNLESGVPARFSGSGSRTDFTLTIDPVEADDAATYYCQQNNEDPWTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLEQSGPELVKPGASVKMSCKASGYTFTNYYMKWVKQSHGKSLEWIGDLNPNNGDTFYNQKFKGKATLTVDKSSNTAYMQLNSLTSEDSAVYYCARTGRYEENAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10045 - protein, 622 aa, Artificial Sequence
  Synthetic Polypeptide
MALPVTALLLPLALLLHAARPDVVMTQSPSSLSASVGDRVTITCMASEDIYIRLAWYQQKPGNAPKLLIYAATSLETGVPSRFSGSGSGTDFTLTISSLQPEDFATYYCQQYWSSPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITSDYTWNWIRQPPGNGLEWIGYITYSGSTSYNPSLKSRVLISVDTSKNQVSLKLSSVTAADTAVYYCARLGRRYTMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10046 - protein, 629 aa, Artificial Sequence
  Synthetic Polypeptide
MALPVTALLLPLALLLHAARPDVLMTQTPVSLSVSLGDQASISCRSSQSIVHSTGNTYLEWYLQKPGQSPKLLIYKISNRFSGVPDRFSGSGSGTDFTLKISRVEAEDLGVYYCFQASHAPRTFGGGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVILVESGGGLVKPGGSLKLSCAASGFTFSSYTMSWVRQTPEKRLEWVATISSGGGNTYYPDSVKGRFTISRDNAKNNLYLQMSSLRSEDTALYYCARYYRYEAWFASWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10047 - protein, 626 aa, Artificial Sequence; identical to SEQ ID NO: 9981
  Synthetic Polypeptide

SEQ ID NO: 10048 - protein, 627 aa, Artificial Sequence
  Synthetic Polypeptide
MALPVTALLLPLALLLHAARPDIQLTQSPSFLSASVGDRVTITCRASQGISTDLNWYQQKPGKAPKLLIYAASNLESGVPSRFSGSGSGTEFTLTISSLQPEDFATYYCQQSYNWPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSNFEMNWVRQAPGKGLEWVSGISSNGRYINYADSVKGRFTISRDNAKNSLYLQMNSLRAEDTAVYYCARVVDFDQDYNGFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10049 - protein, 625 aa, Artificial Sequence
  Synthetic Polypeptide
MALPVTALLLPLALLLHAARPDIQLTQSPSFLSASVGDRVTITCSLSLGISTWRDWFPPRLGRGLEPLTYAASTLQSGVPSRFSGSGSGTEFTLTISSLQPEDFATYYCQQLNSYPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVKPGGSLRLSCAASGFTFSTYGMSWVRQAPGKGLEWVAYINNGSGYIYYADSVKGRFTISRDNAKNSLYLQMNSLRAEDTAVYYCARGQWWSGGDFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10050 - protein, 626 aa, Artificial Sequence
  Synthetic Polypeptide
MALPVTALLLPLALLLHAARPEIVLTQSPATLSLSPGERATLSCSASSSVSYMYWYQQKPGQAPRLLIYRTSNLASGIPARFSGSGSGTDFTLTISSLEPEDFAVYYCQQYHSYPTTFGQGTKVEIKRTVLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFSFNTYAMNWVRQAPGKGLEWVSHIRSKSNNFATYYADSVKDRFTISRDNAKNSLYLQMNSLRAEDTAVYYCARQGGDFPMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10051 - protein, 622 aa, Artificial Sequence
  Synthetic Polypeptide
MALPVTALLLPLALLLHAARPDVVMTQSPSSLSASVGDRVTITCKASEDIYIRLAWYQQKPGKAPKLLIYAATSLETGVPSRFSGSGSGTDFTLTISSLQPEDFATYYCQQYWTTPWTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGYSITIDYTWNWIRQPPGKGLEWIGYITYSGSTDYNPSLKSRVLISVDTSKNQVSLKLSSVTAADTAVYYCARLGRRYALDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10052 - protein, 624 aa, Artificial Sequence
  Synthetic Polypeptide
MALPVTALLLPLALLLHAARPDVVMTQSPSSLSASVGDRVTITCRASQDISKYLNWYQQKPGKAPKLLIYHTSRLHSGVPSRFSGSGSGTDFTLTISSLQPEDFATYYCQQGNTLPYTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGVSLPDYGVSWIRQPPGKGLEWIGVIWGSETTYYNSALKSRVLISVDTSKNQVSLKLSSVTAADTAVYYCARHYYYGGSYAMDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10053 - protein, 626 aa, Artificial Sequence
  Synthetic Polypeptide
MALPVTALLLPLALLLHAARPDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGGGTKLEIKALEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEVQLVESGGGLVKPGGSLKLSCAASGFAFSIYDMSWVRQTPEKRLEWVAYISSGGGTYYPDTVKGRFTISRDNAKNTLYLQMSSLKSEDTAMYYCARHSGYGTHWGVLFAYWGQGTLVTVSATREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10054 - protein, 637 aa, Artificial Sequence
  Synthetic Polypeptide
MALPVTALLLPLALLLHAARPDIVMTQSPDSLAVSLGERATINCKSSQSLLYRSNQKNYLAWYQQKPGQPPKLLIYWASTRESGVPDRFSGSGSGTDFTLTISSLQAEDVAVYYCQQYYNYPRTFGQGTKVEIKRTVLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGYSITSDYAWNWVRQAPGKGLEWVSYISNSGSTSYNPSLKSRFTISRDNSKNTLYLQMNSLRAEDTAVYYCAKERNYDYDDYYYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10055 - protein, 630 aa, Artificial Sequence
  Synthetic Polypeptide
MALPVTALLLPLALLLHAARPDVVMTQSPLSLPVTLGQPASISCRSSQSLLHSSGNTYLEWYQQRPGQSPRPLIYKISTRFSGVPDRFSGSGSGTDFTLKISRVEAEDVGVYYCFQGSHVPYTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGLTIEDYYMHWVRQAPGQGLEWMGWIDPENGDTEYGPKFQGRVTMTRDTSINTAYMELSRLRSDDTAVYYCAVHNAHYGTWFAYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10056 - protein, 622 aa, Artificial Sequence
  Synthetic Polypeptide
MALPVTALLLPLALLLHAARPDIQMTQSPSSLSASVGDRVTITCRASENIYSNLAWYQQKPGKAPKLLIYAATNLADGVPSRFSGSGSGTDFTLTISSLQPEDFATYYCQHFWGTPTFGQGTKVEIKRTVLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFSLTNYGVHWVRQAPGKGLEWVSVIWSGGSTDYNAAFISRFTISADTSKNTAYLQMNSLRAEDTAVYYCARELIHAMDNWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10057 - protein, 629 aa, Artificial Sequence
  Synthetic Polypeptide
MALPVTALLLPLALLLHAARPDFVMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPLTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGAEVKKPGASVKVSCKASGYTFTSYWIHWVRQAPGQGLEWMGENDPSNGRTNYNEKFKNRVTLTVDTSISTAYMELSRLRSDDTAVYYCARGPNYFYSMDYWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10058 - protein, 622 aa, Artificial Sequence
  Synthetic Polypeptide
MALPVTALLLPLALLLHAARPDIQLTQSPSFLSASVGDRVTITCSARSSISFMYWYQQKPGKAPKLLIYDTSNLASGVPSRFSGSGSGTEFTLTISSLEAEDAATYYCQQWSSYPLTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTGSWMNWVRQAPGQGLEWIGRIYPGDGETNYNGKFKDRVTITADKSTSTAYMELSSLRSEDTAVYYCARIYGNNVYFDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10059 - protein, 630 aa, Artificial Sequence
  Synthetic Polypeptide
MALPVTALLLPLALLLHAARPQLVLTQSPSASASLGSSVKLTCTLSSGHKTDTIDWYQQQPGKAPRYLMKLEGSGSYNKGSGVPDRFSGSSSGADWYLTISSLQSEDEADYYCGTDYPGNYLFGGGTQLTVLGLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQEQLVESGGGLVQPGGSLRLSCAASGFTFSDYYMSWIRQAPGKGLEWVATIYPSSGKTYYADSAKGRLTISSDNAKDSLYLQMNSLRAEDTAVYYCTRDSYADDAALFDIWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10060 - protein, 601 aa, Artificial Sequence
  Synthetic Polypeptide
MALPVTALLLPLALLLHAARPEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRASRSRTLILPCTSCGIARAATRACVCSPTSTARPTCPRARTPTCTSPISACWTCGAWTSRATPPWPGPTSPISPAPTPSTTALSPRTHSSQAPRAAATSWWKRASRQTPTTSRTASASSCCKWPALTCPCGCGPAAPREADLASRPISTCSWLATWNPTQALLVWTGFGASFSLSALLPARIPSNRSSWWNQGAVWCSRVGADCHAWRLASHSRTTACTGCDRPPERVWSGSPSGTTDLMSITEILREGSPSPATIAKICSTCKTHSGRMIRRSTIALAQGLLWPAHSITGDRVPWQYQARVRTRTCSHLRWPCSSLARPRSATPRKPPSCAWLPASTPTMWNCLGGSTAKRCTAACVPTPSHKNSPPTTAGTAAADECPPPSGRTPGTTSDARCSSTAARTTSGPRTEPSPPRSCLPKPGAEPIAALPARATSRACAPPSCTRSCWARPPCTPCWCLPWCWLWSSGRTAG

SEQ ID NO: 10061 - protein, 632 aa, Artificial Sequence
  Synthetic Polypeptide
MALPVTALLLPLALLLHAARPDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10062 - protein, 622 aa, Artificial Sequence
  Synthetic Polypeptide
MALPVTALLLPLALLLHAARPEIVMTQSPATLSVSPGERATLSCRASQSVSSNLAWYQQKPGQAPRLLIYGASTRATGIPARFSGSGSGTEFTLTISSLQSEDFAVYYCQQYAAYPTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTSYYMHWVRQAPGQGLEWMGIINPGGGSTSYAQKFQGRVTMTRDTSTSTVYMELSSLRSEDTAVYYCARESWRYALDYWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10063 - protein, 622 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRISWPFTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAEMGAVFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10064 - protein, 627 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQRHVWPPTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQLQLQESGPGLVKPSETLSLTCTVSGGSISSSSYYWGWIRQPPGKGLEWIGSISYSGSTYYNPSLKSRVTISVDTSKNQFSLKLSSVTAADTAVYYCARGRGYATSLAFDIWGQGTMVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10065 - protein, 632 aa, Artificial Sequence
  Synthetic Polypeptide
MALPVTALLLPLALLLHAARPDIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGLGLPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDGTYLGGLWYFDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10066 - protein, 637 aa, Artificial Sequence
  Synthetic Polypeptide
MALPVTALLLPLALLLHAARPDIVMTQSPDSLAVSLGERATINCKSSQSVLYSSNNKNYLAWYQQKPGQPPKLLIYWASTRESGVPDRFSGSGSGTDFTLTISSLQAEDVAVYYCQQFAHTPFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGSSVKVSCKASGGTFSSYAISWVRQAPGQGLEWMGGIIPIFGTANYAQKFQGRVTITADESTSTAYMELSSLRSEDTAVYYCARTPEYSSSIWHYYYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10067 - protein, 628 aa, Artificial Sequence
  Synthetic Polypeptide
MALPVTALLLPLALLLHAARPEIVMTQSPATLSVSPGERATLSCRASQSVSSNLAWYQQKPGQAPRLLIYSASTRATGIPARFSGSGSGTEFTLTISSLQSEDFAVYYCQQHHVWPLTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCVKGPLQEPPYDYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10068 - protein, 624 aa, Artificial Sequence
  Synthetic Polypeptide
MALPVTALLLPLALLLHAARPEIVLTQSPATLSLSPGERATLSCRASQSVSRYLAWYQQKPGQAPRLLIYDASNRATGIPARFSGSGSGTDFTLTISSLEPEDFAVYYCQQRFYYPWTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSSYSMNWVRQAPGKGLEWVSTISSSSSTIYYADSVKGRFTISRDNAKNSLYLQMNSLRAEDTAVYYCARGSQEHLIFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10069 - protein, 625 aa, Artificial Sequence
  Synthetic Polypeptide
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10070 - protein, 627 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSETLSLTCTVSGGSISSYYWSWIRQPPGKGLEWIGYIYYSGSTNYNPSLKSRVTISVDTSKNQFSLKLSSVTAADTAVYYCVSLVYCGGDCYSGFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10071 - protein, 629 aa, Artificial Sequence
  Synthetic Polypeptide
MALPVTALLLPLALLLHAARPDIQLTQSPSSLSASVGDRVSFTCQASQDINNFLNWYQQKPGKAPKLLIYDASNLETGVPSRFSGSGSGTDFTFTISSLQPEDIATYYCQQYGNLPFTFGGGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSQTLSLTCTVSGGSISSGGFYWSWIRQHPGKGLEWIGYIHHSGSTHYNPSLKSRVTISIDTSKNLFSLRLSSVTAADTAVYYCASLVYCGGDCYSGFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10072 - protein, 625 aa, Artificial Sequence
  Synthetic Polypeptide
MALPVTALLLPLALLLHAARPDIQMTQSPSSLSASVGDRVTITCKSSQSVLYSSNQKNYLAWFQQKPGKAPKLLIYWASTRESGVPSRFSGSGSGTDFTLTISSLQPEDFATYFCHQYLSSYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYTFTTYWMHWVRQAPGKGLEWVGYIRPSTGYTEYNQKFKDRFTISADTSKNTAYLQMNSLRAEDTAVYYCARSRWLLDYWGQGTLVTVSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10073 - protein, 622 aa, Artificial Sequence
  Synthetic Polypeptide
MALPVTALLLPLALLLHAARPDIQMTQSPSSLSASVGDRVTITCRASQDISNYLNWYQQKPGKAPKLLIYYTSRLHSGVPSRFSGSGSGTDFTLTISSLQPEDFATYYCQQGNTLPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFTFSDYFMSWVRQAPGKGLEWVATISNGGTYTYYPDSVKGRFTISRDNSKNTLYLQMNSLRAEDTAVYYCARFDGYIFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10074 - protein, 623 aa, Artificial Sequence
  Synthetic Polypeptide
MALPVTALLLPLALLLHAARPEIVLTQSPATLSLSPGERATLSCSASSSVSYMHWYQQKPGQAPRLLIYDTSKLASDIPARFSGSGSGTDFTLTISSLEPEDFAVYYCQQGSVYPFTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLQESGPGLVKPSGTLSLTCAVSGGSISTSGMGVGWVRQPPGKGLEWIGHIWWDDDKRYNPALKSRVTISVDKSKNQFSLRLSSVTAADTAVYYCARMELWSYYFDYWGKGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10075 - protein, 629 aa, Artificial Sequence
  Synthetic Polypeptide
MALPVTALLLPLALLLHAARPDIQMTQSPSSLSASVGDRVTITCTASSRVSSSYLHWFQQKPGKAPKLLIYSTSNLASGVPSRFSGSGSGTDFTLTISSLQPEDFATYYCHQYHRSPYTFGQGTKVEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGYAFSNSWINWVRQAPGKGLEWVGQIYPGDYDTNYNGKFKGRFTISRDKSKNTAYLQMNSLRAEDTAVYYCARGGSIYYGNLGFFDVWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10076 - protein, 619 aa, Artificial Sequence
  Synthetic Polypeptide
MALPVTALLLPLALLLHAARPDIQMTQSPSSLSASVGDRVTITCSASSSVTYMYWYQQKPGKAPKLLIYDTSNLASGVPSRFSGSGSGTDYTLTISSLQPEDFATYYCQQWSNYPLTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYSFIEYTINWVRQAPGQGLEWIGNIDPYYGTTYYNQMFTGRATLTVDTSISTAYMELSRLRSDDTAVYYCARGSAWFPYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10077 - protein, 619 aa, Artificial Sequence
  Synthetic Polypeptide
MALPVTALLLPLALLLHAARPEIVLTQSPSSLSASVGDRVTITCRASENIYSYLAWYQQKPGKAPKLLIYNTKTLGEGVPSRFSGSGSGTDFTLTISSLQPEDFATYYCQHHYGTPFTFGPGTKVDIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFLILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFSDYWVHWVRQAPGQGLEWMGAIDGSDTFNDYSQKFKGRVTMTRDTSISTAYMELSRLRSDDTAVYYCARGGLLQYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10078 - skipped

SEQ ID NO: 10079 - protein, 623 aa, Artificial Sequence
  Synthetic Polypeptide
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10080 - protein, 624 aa, Artificial Sequence
  Synthetic Polypeptide
MALPVTALLLPLALLLHAARPEIVMTQSPATLSLSPGERATLSCRASQDISKYLNWYQQKPGQAPRLLIYHTSRLHSGIPARFSGSGSGTDYTLTISSLQPEDFAVYFCQQGNTLPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSETLSLTCTVSGVSLPDYGVSWIRQPPGKGLEWIGVIWGSETTYYNSSLKSRVTISKDNSKNQVSLKLSSVTAADTAVYYCAKHYYYGGSYAMDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 10081 - protein, 625 aa, Artificial Sequence
  Synthetic Polypeptide
MALPVTALLLPLALLLHAARPDEIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVALFALLMTLRLWSSRAKRSGSGVKQTLNFDLLKLAGDVESNPGPTSMDWIWRILFLVGAATGAHSFEQVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG
